(12) United States Patent
Gordon-Kamm et al.

(10) Patent No.: US 12,146,147 B2
(45) Date of Patent: Nov. 19, 2024

(54) METHODS FOR CLONAL PLANT PRODUCTION

(71) Applicant: PIONEER HI-BRED INTERNATIONAL, INC., Johnston, IA (US)

(72) Inventors: William James Gordon-Kamm, Urbandale, IA (US); Keith S Lowe, Johnston, IA (US); Jon Aaron Tucker Reinders, Clive, IA (US); Huaxun Ye, Johnston, IA (US)

(73) Assignee: PIONEER HI-BRED INTERNATIONAL, INC., Johnston, IA (US)

( * ) Notice: Subject to any disclaimer, the term of this patent is extended or adjusted under 35 U.S.C. 154(b) by 413 days.

(21) Appl. No.: 17/437,791

(22) PCT Filed: Mar. 10, 2020

(86) PCT No.: PCT/US2020/021844
§ 371 (c)(1),
(2) Date: Sep. 9, 2021

(87) PCT Pub. No.: WO2020/185751
PCT Pub. Date: Sep. 17, 2020

(65) Prior Publication Data
US 2022/0154203 A1    May 19, 2022

Related U.S. Application Data

(60) Provisional application No. 62/816,580, filed on Mar. 11, 2019.

(51) Int. Cl.
*C12N 15/82* (2006.01)
*C07K 14/415* (2006.01)

(52) U.S. Cl.
CPC ........ *C12N 15/8267* (2013.01); *C07K 14/415* (2013.01); *C12N 15/8213* (2013.01); *C12N 15/8216* (2013.01)

(58) Field of Classification Search
CPC .................................................. C12N 15/8267
See application file for complete search history.

(56) References Cited

U.S. PATENT DOCUMENTS

| | | | |
|---|---|---|---|
| 4,959,317 A | 9/1990 | Sauer | |
| 5,573,932 A * | 11/1996 | Ellis | C12N 15/67 536/23.6 |
| 6,399,855 B1 | 6/2002 | Beavis | |
| 6,800,791 B1 | 10/2004 | Bailey et al. | |
| 7,572,635 B2 | 8/2009 | Armstrong et al. | |
| 7,579,529 B2 | 8/2009 | Gordon-Kamm et al. | |
| 8,030,560 B2 * | 10/2011 | Zhao | A01H 5/10 435/468 |
| 8,039,686 B2 | 10/2011 | Podlich et al. | |
| 8,321,147 B2 | 11/2012 | Bink et al. | |
| 8,334,429 B2 | 12/2012 | Ranch et al. | |
| 8,574,910 B2 | 11/2013 | Falco et al. | |
| 8,859,846 B2 | 10/2014 | Barton et al. | |
| 8,865,971 B2 | 10/2014 | Zhao et al. | |
| 9,121,032 B2 | 9/2015 | Williams et al. | |
| 10,031,116 B2 | 7/2018 | Geha et al. | |
| 10,102,476 B2 | 10/2018 | Caraviello et al. | |
| 10,280,472 B2 | 5/2019 | Arnold et al. | |
| 10,285,348 B2 | 5/2019 | Kelliher et al. | |
| 10,640,779 B2 | 5/2020 | Cogan et al. | |
| 11,193,131 B2 * | 12/2021 | Campbell | C12N 9/22 |
| 11,330,776 B2 * | 5/2022 | Anand | A01H 4/008 |
| 11,401,524 B2 | 8/2022 | Armstrong et al. | |
| 11,447,786 B2 | 9/2022 | Fox et al. | |
| 11,732,269 B2 | 8/2023 | Kerstetter et al. | |
| 2002/0023278 A1 | 2/2002 | Lyznik et al. | |
| 2002/0188965 A1 | 12/2002 | Zhao et al. | |
| 2005/0257289 A1 | 11/2005 | Gordon-Kamm et al. | |
| 2005/0289673 A1 | 12/2005 | Armstrong et al. | |
| 2007/0271628 A1 | 11/2007 | Lowe et al. | |
| 2013/0198893 A1 | 8/2013 | Zhao et al. | |
| 2014/0359897 A1 | 12/2014 | Kelliher et al. | |
| 2015/0121561 A1 | 4/2015 | Koivu | |
| 2015/0152430 A1 | 6/2015 | Albertsen et al. | |
| 2016/0212956 A1 | 7/2016 | Boutilier et al. | |
| 2016/0304901 A1 | 10/2016 | Ozias-Akins et al. | |
| 2016/0321396 A1 | 11/2016 | Habier | |
| 2017/0183677 A1 | 6/2017 | Gao et al. | |
| 2017/0245446 A1 | 8/2017 | Cooper et al. | |
| 2017/0359978 A1 | 12/2017 | Technow et al. | |
| 2018/0094273 A1 | 4/2018 | Kumar et al. | |

(Continued)

FOREIGN PATENT DOCUMENTS

| | | |
|---|---|---|
| CN | 104031936 A | 9/2014 |
| JP | 2017155715 A | 9/2017 |

(Continued)

OTHER PUBLICATIONS

Florez, et al.: "Enhanced somatic embryogenesis in Theobroma cacao using the homologous Baby Boom transcription factor," BMC Plant Biology, 2015, vol. 15, No. 121.

Kelliher, Timothy; et al.: One-step genome editing of elite crop germplasm during haploid induction, Nature iotechnology, Mar. 2019, vol. 37, pp. 287-292.

Lowe, Keith; et al.: "Morphogenic Regulators Baby boom and Wuschel Improve Monocot Transformation," The Plant Cell, Sep. 10, 2016 (Sep. 10, 2016), vol. 28, No. 9, pp. 1998-2015.

Rodriguez, Kevin; et al.: "DNA-dependent homodimerization, subcellular partitioning, and protein destabilization control WUSCHEL levels and spatial patterning," PNAS, Sep. 26, 2016 (Sep. 26, 2016), E6307-E6315.

(Continued)

*Primary Examiner* — Russell Kallis

(57) ABSTRACT

The methods disclosed herein provide for clonal plant production using a morphogenic gene to produce non-transgenic and transgenic plants wherein the morphogenic gene does not integrate into the genome of the plant.

34 Claims, 15 Drawing Sheets

Specification includes a Sequence Listing.

(56) References Cited

U.S. PATENT DOCUMENTS

| | | |
|---|---|---|
| 2018/0216123 A1 | 8/2018 | Anand et al. |
| 2018/0245090 A1 | 8/2018 | Campbell et al. |
| 2018/0265877 A1 | 9/2018 | Anand et al. |
| 2018/0363069 A1 | 12/2018 | Bakiwala et al. |
| 2023/0203516 A1 | 6/2023 | Fox et al. |

FOREIGN PATENT DOCUMENTS

| | | | |
|---|---|---|---|
| WO | 2002/085104 A2 | 10/2002 | |
| WO | 2005063990 A2 | 7/2005 | |
| WO | 2005075655 A2 | 8/2005 | |
| WO | 2006116876 A1 | 11/2006 | |
| WO | 2006128707 A1 | 12/2006 | |
| WO | 2011082318 A2 | 7/2011 | |
| WO | 2015/061355 A1 | 4/2015 | |
| WO | 2015048016 A2 | 4/2015 | |
| WO | 2015167956 A1 | 11/2015 | |
| WO | 2016/146552 A1 | 9/2016 | |
| WO | 2016149352 A1 | 9/2016 | |
| WO | WO-2017004375 A1 * | 1/2017 | ............... A01H 1/06 |
| WO | 2017017108 A1 | 2/2017 | |
| WO | 2017070032 A1 | 4/2017 | |
| WO | 2017/078836 A1 | 5/2017 | |
| WO | 2017/153766 A1 | 9/2017 | |
| WO | 2017/155715 A1 | 9/2017 | |
| WO | 2018015956 A1 | 1/2018 | |
| WO | 2018015957 A1 | 1/2018 | |
| WO | 2018/098420 A1 | 5/2018 | |
| WO | 2018/183878 A1 | 10/2018 | |
| WO | 2019075295 A1 | 4/2019 | |
| WO | 2019185849 A1 | 10/2019 | |

OTHER PUBLICATIONS

International Search Report and Written Opinion for International Application PCT/US2020/021844, Mailed Aug. 3, 2020.
Copenhaver G.P., et al., "Tetrad Analysis in Higher Plants. A Budding Technology," Plant Physiology, 2000, vol. 124, pp. 7-15.
International Preliminary Report on Patentability for International Application No. PCT/US2018/055561, mailed Apr. 23, 2020, 10 Pages.
International Preliminary Report on Patentability for International Application No. PCT/US2020/021844, mailed Sep. 23, 2021, 14 Pages.
International Search Report and Written Opinion for International Application No. PCT/US2018/055561, mailed Mar. 8, 2019, 19 Pages.
Kunitake H., et al., "Isolation and Culture of Asparagus Microspore Protoplasts," Japanese Journal of Breeding, 1993, vol. 43, pp. 231-238.
Kunz C., et al., "Assessment and Improvement of Wheat Microspore Derived Embryo Induction and Regeneration," Journal of Plant Physiology, Feb. 1, 2000, vol. 156, No. 2, pp. 190-196.
Li X., et al., "Dissecting Meiotic Recombination based on Tetrad Analysis by Single-Microspore Sequencing in Maize," Nature Communications, Mar. 24, 2015, vol. 6, No. 6648, 9 Pages.
Murovec J., et al., "Haploids and Doubled Haploids in Plant Breeding," Plant Breeding, 2012, pp. 87-106, 21 pages.
Stieglitz H., "Role of Beta-1, 3-Glucanase in Postmeiotic Microspore Release," Developmental Biology, 1977, vol. 57, pp. 87-97.

* cited by examiner

METHODS FOR CLONAL PLANT PRODUCTION

CROSS-REFERENCE TO RELATED APPLICATIONS

This application claims the benefit of PCT Application Serial Number PCT/US2020/021844, filed Mar. 10, 2020, which claims the benefit of U.S. Provisional Application No. 62/816,580, filed Mar. 11, 2019, all of which are hereby incorporated herein by reference in their entireties.

FIELD OF THE DISCLOSURE

The present disclosure relates generally to the field of plant molecular biology, including plant tissue culture methods. More specifically, the present disclosure pertains to rapid, highly efficient methods for clonal haploid plant propagation and micropropagation of recalcitrant plant species useful for plant breeding.

REFERENCE TO A SEQUENCE LISTING SUBMITTED AS A TEXT FILE VIA EFS-WEB

The official copy of the sequence listing is submitted electronically via EFS-Web as an ASCII formatted sequence listing with a file named 8041-US-PCT_ST25, created on Sep. 9, 2021, and having a size of 1,342,338 bytes and is filed concurrently with the specification. The sequence listing contained in this ASCII formatted document is part of the specification and is herein incorporated by reference in its entirety.

BACKGROUND

Plant breeding programs identify new cultivars by screening numerous plants to identify individuals with desirable characteristics. Large numbers of progeny from crosses are typically grown and evaluated, ideally across multiple years and environments, to select the plants with the most desirable characteristics.

Typical breeding methods cross two parental plants and the filial 1 hybrid ($F_1$ hybrid), is the first filial generation. Hybrid vigor in a commercial $F_1$ hybrid is observed when two parental strains, (typically inbreds), from different heterotic groups are intercrossed. Hybrid vigor, the improved or increased function of any biological quality resulting after combining the genetic contributions of its parents, is important to commercial maize seed production and these commercial hybrid performance improvements require the continued development of new inbred parental lines.

Maize inbred line development methods use maternal (gynogenic) doubled haploid production, in which maternal haploid embryos are selected following the fertilization of the ear of a plant resultant from a first-generation cross that has been fertilized with pollen from a so-called "haploid inducer" line. Pollination of a female flower with pollen of a haploid inducer strain results in elevated levels of ovules that contain only the haploid maternal genome, as opposed to inheriting a copy of both the maternal and paternal genome, thus, creating maternal haploid embryos. Ovules within the female flower are the products of meiosis and each maternal ovule is a unique meiotically recombined haploid genome, thereby allowing immature maternal haploid embryos to be isolated and treated using in vitro tissue culture methods that include chromosome doubling treatments to rapidly enable generating maternal doubled haploid recombinant populations. Many maize maternal haploid embryos resultant from fertilizing a target plant with pollen from a maize haploid inducer line fail to regenerate into a fertile, doubled haploid plant and few, if any, in vitro tissue culture and plantlet regeneration methods propagate multiple, fertile plants from one haploid embryo. Thus, there is a need for improving methods of producing doubled haploid plants applicable to maternal gamete doubled haploids in maize.

Most maize inbreds are recalcitrant to microspore isolation, in vitro tissue culture, and plantlet regeneration methods to create paternal (androgenic) gamete doubled haploids. Thus, there is a need for a method of producing doubled haploid plants applicable to paternal gamete doubled haploids in maize.

Cytoplasmic Male-Sterile (CMS) female lines are produced in the trait introgression process, which requires hand pollination and often results in low seed amounts. This limitation of low seed set is compounded in winter wheat by the requirement for vernalization, limiting the process to one cycle per year. Accelerated propagation would speed up this process, decreasing time to market and cost of goods.

Plant breeders would thus benefit from methods of developing populations of non-recombinant and recombinant inbred lines that do not require extensive pollination control methods or the prolonged time required for propagating self-fertilized lines into isogenic states.

SUMMARY

The present disclosure comprises methods and compositions for 1n and 2n cells and plants useful in crop breeding programs. In a further aspect, the present disclosure provides a seed from the plant produced by the methods disclosed herein.

The present disclosure provides a method of producing a clonal plant comprising providing to a first plant cell a morphogenic gene expression cassette; eliciting a growth response in a second plant cell, wherein the second plant cell does not contain the morphogenic gene expression cassette; and regenerating the clonal plant from the second plant cell. In a further aspect, the first plant cell is a cell derived from a 1n cell. In a further aspect, the 1n cell is a microspore. In an aspect, the 1n cell is an embryo. In a further aspect, the first plant cell is a zygotic embryo. In a further aspect, the first plant cell is a 2n embryo. In a further aspect, the providing to the first plant cell comprises particle gun delivery of the morphogenic gene expression cassette. In a further aspect, the providing to the first plant cell comprises bacterial-mediated delivery of the morphogenic gene expression cassette. In a further aspect, the morphogenic gene expression cassette comprises (i) a nucleotide sequence encoding a functional WUS/WOX polypeptide; (ii) a nucleotide sequence encoding a Babyboom (BBM) polypeptide or an Ovule Development Protein 2 (ODP2) polypeptide; (iii) a combination of (i) and (ii). In a further aspect, the nucleotide sequence encoding the functional WUS/WOX polypeptide is selected from the group consisting of WUS1, WUS2, WUS3, WOX2 A, WOX4, WOX5, and WOX9. In a further aspect, the nucleotide sequence encodes the Babyboom (BBM) polypeptide or the Ovule Development Protein 2 (ODP2) polypeptide. In a further aspect, the nucleotide sequence encoding the Babyboom (BBM) polypeptide is selected from the group consisting of BBM2, BMN2, and BMN3 or the Ovule Development Protein 2 (ODP2) polypeptide is ODP2. In a further aspect, the nucleotide sequence encodes the functional WUS/WOX polypeptide and the Babyboom (BBM) polypeptide or the Ovule Development Protein 2 (ODP2) polypeptide. In a further aspect, the nucleotide sequence encoding the functional WUS/WOX polypeptide is selected from the group consisting of WUS1, WUS2, WUS3, WOX2 A, WOX4, WOX5, and WOX9 and the Babyboom (BBM) polypeptide is selected from the group consisting of BBM2, BMN2, and BMN3 or the Ovule Development Protein 2 (ODP2) polypeptide is ODP2. In a further aspect, the bacterial-mediated delivery is provided by a Rhizobiales bacterial strain. In a further aspect, the Rhizobiales bacterial strain is selected from the group consisting of a disarmed *Agrobacterium*, an *Ochrobactrum* bacteria, and a Rhizobiaceae bacteria. In a further aspect, the disarmed *Agrobacterium* a is selected from the group of AGL-1, EHA105, GV3101, LBA4404, and LBA4404 THY-. In a further aspect, the *Ochrobactrum* bacteria is selected from Table 2. In a further aspect, the Rhizobiaceae bacteria is selected from Table 3. In a further aspect, the morphogenic gene expression cassette further comprises a promoter selected from Table 4 or Table 5. In a further aspect, the morphogenic gene expression cassette comprises a PLTP promoter operably linked to the nucleotide sequence encoding a functional WUS/WOX polypeptide. In a further aspect, the morphogenic gene expression cassette further comprises an expression modulating element (EME) selected from Table 6. In a further aspect, the morphogenic gene expression cassette further comprises an enhancer selected from Table 7. In a further aspect, the morphogenic gene expression cassette further comprises an expression modulating element (EME) selected from Table 6 and an enhancer selected from Table 7. In a further aspect, the expression modulating element (EME) comprises three copies of an expression modulating element (EME) selected from Table 6. In a further aspect, the enhancer comprises three copies of an enhancer selected from Table 7. In a further aspect, the expression modulating element (EME) comprises three copies of an expression modulating element (EME) selected from Table 6 and the enhancer comprises three copies of an enhancer selected from Table 7. In a further aspect, the three copies of the expression modulating element (EME) are the same expression modulating element (EME) selected from Table 6 or are different expression modulating elements (EMEs) selected from Table. In a further aspect, the three copies of the enhancer are the same enhancer selected from Table 7 or are different enhancers selected from Table 7. In a further aspect, the three copies of the expression modulating element (EME) are the same expression modulating element (EME) selected from Table 6 or are different expression modulating elements (EMEs) selected from Table 6 and the three copies of the enhancer are the same enhancer selected from Table 7 or are different enhancers selected from Table 7. In a further aspect, the morphogenic gene expression cassette further comprises a Ubiquitin promoter operably linked to a LEC1 gene. In a further aspect, the morphogenic gene expression cassette further comprises a PLTP promoter operably linked to a LEC1 gene. In a further aspect, the nucleotide sequence encoding a functional WUS/WOX polypeptide is fused to a T2 A viral peptide LEC1 gene fusion. In a further aspect, the morphogenic gene expression cassette further comprises a viral or plant enhancer sequence. In a further aspect, the nucleotide sequence encoding a functional WUS/WOX polypeptide is fused to a T2 A viral peptide BBM gene fusion. In a further aspect, the nucleotide sequence encoding a functional WUS/WOX polypeptide is fused to a T2 A viral peptide RepA gene fusion. In a further aspect, the morphogenic gene expression cassette further comprises a PLTP promoter operably linked to a PKLamiRNA fusion. In a further aspect, the method further comprising contacting the second plant cell with a chromosome doubling agent and regenerating a doubled haploid plant. In a further aspect, the method further comprises crossing a regenerated clonal plant with a plant comprising a desired genotype/phenotype and growing offspring having the desired genotype/phenotype. In a further aspect, a plant seed and any progeny derived therefrom having the desired genotype/phenotype is provided. In a further aspect, a plant seed and any progeny derived therefrom, and a plant seed and any progeny derived therefrom resulting from a cross of a regenerated clonal plant with a plant comprising a desired genotype/phenotype is provided. In a further aspect, the method further comprises characterizing the second plant cell or a cell derived from the second plant cell; predicting phenotypic performance using a biological model based on genomic data of the characterized second plant cell or the characterized cell derived from the second plant cell; selecting the second plant cell or the cell derived from the second plant cell based on its predicted phenotypic performance; and regenerating a clonal plant derived from the selected second plant cell or the selected cell derived from the second plant cell. In a further aspect, the characterizing is selected from the group consisting of genotyping DNA isolated from the second plant cell or the cell derived from the second plant cell; measuring RNA transcripts isolated from the second plant cell or the cell derived from the second plant cell; measuring nucleosome abundance or densities of chromatin isolated from the second plant cell or the cell derived from the second plant cell; measuring post-translational modifications of histone proteins of chromatin isolated from the second plant cell or the cell derived from the second plant cell; measuring epigenetic modifications of DNA or RNA isolated from the second plant cell or the cell derived from the second plant cell; measuring protein:DNA interactions of chromatin isolated from the second plant cell or the cell derived from the second plant cell; measuring protein:RNA interactions or complexes isolated from the second plant cell or the cell derived from the second plant cell, and a combination of the foregoing. In a further aspect, the predicting phenotypic performance is selected from the group consisting of using genomic data based on genotyping by DNA sequencing of the second plant cell or the cell derived from the second plant cell; using genomic data based on genotyping by assay of the second plant cell or the cell derived from the second plant cell; using genomic data based on a known or predicted expression state of the second plant cell or the cell derived from the second plant cell; using genomic data based on a known or predicted chromatin state of the second plant cell or the cell derived from the second plant cell; using genomic data based on a known or predicted epigenetic regulatory state of the second plant cell or the cell derived from the second plant cell; using genotype imputation of shared haplotype genomic data of the second plant cell or the cell derived from the second plant cell and/or pedigree history data of the second plant cell or the cell derived from the second plant cell; and a combination of the foregoing. In a further aspect, the second plant cell or the cell derived from the second plant cell is selected from the group consisting of callus, undifferentiated callus, immature embryos, mature embryos, immature zygotic embryos, immature cotyledon, embryonic axis, suspension culture cells, protoplasts, leaf, leaf cells, root cells, phloem cells, pollen, seeds, suspension cultures, explants, embryos, zygotic embryos, somatic embryos, embryogenic callus, meristem, somatic meristems, organogenic callus, embryos derived from mature ear-derived seed, leaf bases, leaves from mature plants, leaf tips, immature inflorescences, tassel, immature ear, silks, cotyledons, meristematic regions, cells from leaves, cells from stems, cells from roots, cells from shoots, gametophytes, sporophytes, microspores, multicellular structures (MCS), embryo-like structures; and a combination of the foregoing. In a further aspect, a plant seed of the regenerated clonal plant and a plant seed or any progeny resulting from crossing the regenerated clonal plant with another plant and growing the offspring of the cross with one or more desired traits is provided.

The present disclosure provides a method of producing a transgenic plant having one copy of a trait gene expression cassette comprising providing to a haploid embryo or an embryo-like structure a trait gene expression cassette and a morphogenic gene expression cassette; selecting a haploid embryo or a haploid embryo-like structure containing the trait gene expression cassette and no morphogenic gene expression cassette; contacting the selected haploid embryo or the selected haploid embryo-like structure with a chromosome doubling agent for a period sufficient to generate a doubled haploid embryo or a doubled haploid embryo-like structure; and regenerating a transgenic plant from the selected doubled haploid embryo or the selected doubled haploid embryo-like structure containing the trait gene expression cassette and no morphogenic gene expression cassette. In a further aspect, the providing to the haploid embryo or the embryo-like structure comprises particle gun delivery of the trait gene expression cassette and the morphogenic gene expression cassette. In a further aspect, the providing to the haploid embryo or the embryo-like structure comprises simultaneously contacting the haploid embryo or the embryo-like structure with the trait gene expression cassette and the morphogenic gene expression cassette. In a further aspect, the providing to the haploid embryo or the embryo-like structure comprises sequentially contacting the haploid embryo or the embryo-like structure with the trait gene expression cassette and the morphogenic gene expression cassette. In a further aspect, the providing to the haploid embryo or the embryo-like structure comprises bacterial-mediated delivery of the trait gene expression cassette and the morphogenic gene expression cassette. In a further aspect, the bacterial-mediated delivery comprises simultaneously contacting the haploid embryo or the embryo-like structure with a T-DNA containing the trait gene expression cassette in a first bacterial strain and a T-DNA containing the morphogenic gene expression cassette in a second bacterial strain. In a further aspect, the bacterial-mediated delivery comprises contacting the haploid embryo or the embryo-like structure with a T-DNA containing the trait gene expression cassette and a T-DNA containing the morphogenic gene expression cassette in one bacterial strain. In a further aspect, the morphogenic gene expression cassette comprises (i) a nucleotide sequence encoding a functional WUS/WOX polypeptide; (ii) a nucleotide sequence encoding a Babyboom (BBM) polypeptide or an Ovule Development Protein 2 (ODP2) polypeptide; (iii) a combination of (i) and (ii). In a further aspect, the nucleotide sequence encoding the functional WUS/WOX polypeptide is selected from the group consisting of WUS1, WUS2, WUS3, WOX2 A, WOX4, WOX5, and WOX9. In a further aspect, the nucleotide sequence encodes the Babyboom (BBM) polypeptide or the Ovule Development Protein 2 (ODP2) polypeptide. In a further aspect, the nucleotide sequence encoding the Babyboom (BBM) polypeptide is selected from the group consisting of BBM2, BMN2, and BMN3 or the Ovule Development Protein 2 (ODP2) polypeptide is ODP2. In a further aspect, the nucleotide sequence encodes the functional WUS/WOX polypeptide and the Babyboom (BBM) polypeptide or the Ovule Development Protein 2 (ODP2) polypeptide. In a further aspect, the nucleotide sequence encoding the functional WUS/WOX polypeptide is selected from the group consisting of WUS1, WUS2, WUS3, WOX2 A, WOX4, WOX5, and WOX9 and the Babyboom (BBM) polypeptide is selected from the group consisting of BBM2, BMN2, and BMN3 or the Ovule Development Protein 2 (ODP2) polypeptide is ODP2. In a further aspect, the trait gene expression cassette comprises a trait gene selected from the group consisting of a gene conferring pest resistance, a gene conferring herbicide resistance, a gene conferring stress tolerance, a gene conferring drought resistance, a gene conferring nitrogen use efficiency (NUE), a gene conferring disease resistance, and a gene conferring an ability to alter a metabolic pathway. In a further aspect, the trait gene expression cassette further comprises a nucleotide sequence encoding a Babyboom (BBM) polypeptide or an Ovule Development Protein 2 (ODP2) polypeptide. In a further aspect, the nucleotide sequence encoding the Babyboom (BBM) polypeptide is selected from the group consisting of BBM2, BMN2, and BMN3 or the Ovule Development Protein 2 (ODP2) polypeptide is ODP2. In a further aspect, the trait gene expression cassette or the morphogenic gene expression cassette further comprises a polynucleotide encoding a site-specific nuclease. In a further aspect, the site-specific nuclease is selected from the group consisting of a zinc finger nuclease, a meganuclease, TALEN, and a CRISPR-Cas nuclease. In a further aspect, the CRISPR-Cas nuclease is Cas9 or Cpf1 nuclease. In a further aspect, the site-specific nuclease effects an insertion, a deletion, or a substitution mutation. In a further aspect, the method further comprises providing a guide RNA expressed from the trait gene expression cassette or the morphogenic gene expression cassette. In a further aspect, the guide RNA and CRISPR-Cas nuclease is a ribonucleoprotein complex. In a further aspect, the bacterial-mediated delivery is provided by a Rhizobiales bacterial strain. In a further aspect, the Rhizobiales bacterial strain is selected from the group consisting of a disarmed *Agrobacterium*, an *Ochrobactrum* bacteria, and a Rhizobiaceae bacteria. In a further aspect, the first bacterial strain and the second bacterial strain are the same bacterial strain. In a further aspect, the same bacterial strain is selected from the group of a disarmed *Agrobacterium*, an *Ochrobactrum* bacteria, and a Rhizobiaceae bacteria. In a further aspect, the disarmed *Agrobacterium* is selected from the group of AGL-1, EHA105, GV3101, LBA4404, and LBA4404 THY-. In a further aspect, the *Ochrobactrum* bacteria is selected from Table 2 In a further aspect, the Rhizobiaceae bacteria is selected from Table 3. In a further aspect, the first bacterial strain and the second bacterial strain are different bacterial strains. In a further aspect, the different bacterial strains are selected from (i) a disarmed *Agrobacterium* and an *Ochrobactrum* bacteria; (ii) a disarmed *Agrobacterium* and a Rhizobiaceae bacteria; and (iii) a Rhizobiaceae bacteria and an *Ochrobactrum* bacteria. In a further aspect, the disarmed *Agrobacterium* is selected from the group of AGL-1, EHA105, GV3101, LBA4404, and LBA4404 THY-. In a further aspect, the *Ochrobactrum* bacteria is selected from Table 2. In a further aspect, the Rhizobiaceae bacteria is selected from Table 3. In a further aspect, the first bacterial strain and the second bacterial strain are present in a 50:50 ratio. In a further aspect, the first bacterial strain and the second bacterial strain are present in a 75:25 ratio. In a further aspect, the first bacterial strain and the second bacterial strain are present in a 90:10 ratio. In a further aspect, the first bacterial strain and the second bacterial strain are present in a 95:5 ratio. In a further aspect, the first bacterial strain and the second bacterial strain are present in a 99:1 ratio. In a further aspect, the morphogenic gene expression cassette further comprises a promoter selected from Table 4 or Table 5. In a further aspect, the morphogenic gene expression cassette comprises a PLTP promoter operably linked to the nucleotide sequence encoding a functional WUS/WOX polypeptide. In a further aspect, the morphogenic gene expression cassette further comprises an expression modulating element (EME) selected from Table 6 In a further aspect, the morphogenic gene expression cassette further comprises an enhancer selected from Table 7. In a further aspect, the morphogenic gene expression cassette further comprises an expression modulating element (EME) selected from Table 6 and an enhancer selected from Table 7. In a further aspect, the expression modulating element (EME) comprises three copies of an expression modulating element (EME) selected from Table 6. In a further aspect, the enhancer comprises three copies of an enhancer selected from Table 7. In a further aspect, the expression modulating element (EME) comprises three copies of an expression modulating element (EME) selected from Table 6 and the enhancer comprises three copies of an enhancer selected from Table 7. In a further aspect, the expression modulating element (EME) comprises three copies of an expression modulating element (EME) selected from Table 6 and the enhancer comprises three copies of an enhancer selected from Table 7. In a further aspect, the three copies of the expression modulating element (EME) are the same expression modulating element (EME) selected from Table 6 or are different expression modulating elements (EMEs) selected from Table. In a further aspect, the three copies of the enhancer are the same enhancer selected from Table 7 or are different enhancers selected from Table 7. In a further aspect, the three copies of the expression modulating element (EME) are the same expression modulating element (EME) selected from Table 6 or are different expression modulating elements (EMEs) selected from Table 6 and the three copies of the enhancer are the same enhancer selected from Table 7 or are different enhancers selected from Table 7. In a further aspect, the morphogenic gene expression cassette further comprises a Ubiquitin promoter operably linked to a LEC1 gene. In a further aspect, the morphogenic gene expression cassette further comprises a PLTP promoter operably linked to a LEC1 gene. In a further aspect, the nucleotide sequence encoding a functional WUS/WOX polypeptide fused to a T2A viral peptide LEC1 gene fusion. In a further aspect, the morphogenic gene expression cassette further comprises a viral or plant enhancer sequence. In a further aspect, the nucleotide sequence encoding a functional WUS/WOX polypeptide is fused to a T2A viral peptide BBM gene fusion. In a further aspect, the nucleotide sequence encoding a functional WUS/WOX polypeptide is fused to a T2A viral peptide RepA gene fusion. In a further aspect, the morphogenic gene cassette further comprises a PLTP promoter operably linked to a PKLamiRNA fusion. In a further aspect, the method further comprises crossing the regenerated transgenic doubled haploid plant with a plant comprising a desired genotype/phenotype; and growing offspring having the desired genotype/phenotype. In a further aspect, a plant seed and any progeny derived therefrom having the desired genotype/phenotype is provided. In a further aspect, a plant seed and any progeny derived therefrom, and a plant seed and any progeny derived therefrom resulting from a cross of a regenerated transgenic plant with a plant comprising a desired genotype/phenotype is provided.

The present disclosure provides a method of producing a genetic recombinant plant resulting from the product of meiosis, comprising providing to a 2n embryo resulting from a biparental cross a morphogenic gene expression cassette to induce somatic embryogenesis; exposing the 2n embryo to conditions before, during, or after somatic embryogenesis induction, thereby changing the cell fate of the 2n embryo and allowing entry of the 2n embryo into meiosis thereby producing a 1n embryo; selecting a 1n embryo containing no morphogenic gene expression cassette; contacting the 1n embryo with a chromosome doubling agent for a period sufficient to generate a doubled 1n embryo; and regenerating a genetic recombinant plant from the doubled 1n embryo containing no morphogenic gene expression cassette. In a further aspect, the method further comprises obtaining seed or progeny thereof from the genetic recombinant plant containing no morphogenic gene expression cassette. In a further aspect, the providing and/or exposing comprises particle gun delivery. In a further aspect, the particle gun delivery comprises simultaneously contacting the 2n embryo with the morphogenic gene expression cassette and a meiosis induction expression cassette. In a further aspect, the particle gun delivery comprises sequentially contacting the 2n embryo with the morphogenic gene expression cassette and a meiosis induction expression cassette. In a further aspect, the providing and/or exposing comprises bacterial-mediated delivery. In a further aspect, the bacterial-mediated delivery comprises simultaneously contacting the 2n embryo with a T-DNA containing the morphogenic gene expression cassette in a first bacterial strain and a T-DNA containing a meiosis induction expression cassette in a second bacterial strain. In a further aspect, the bacterial-mediated delivery comprises contacting the 2n embryo with a T-DNA containing the morphogenic gene expression cassette and a T-DNA containing a meiosis induction expression cassette in one bacterial strain. In a further aspect, the morphogenic gene expression cassette comprises (i) a nucleotide sequence encoding a functional WUS/WOX polypeptide; (ii) a nucleotide sequence encoding a Babyboom (BBM) polypeptide or an Ovule Development Protein 2 (ODP2) polypeptide; (iii) a combination of (i) and (ii). In a further aspect, the nucleotide sequence encoding functional WUS/WOX polypeptide is selected from WUS1, WUS2, WUS3, WOX2 A, WOX4, WOX5, and WOX9. In a further aspect, the nucleotide sequence encodes the Babyboom (BBM) polypeptide or the Ovule Development Protein 2 (ODP2) polypeptide. In a further aspect, the nucleotide sequence encoding the Babyboom (BBM) polypeptide is selected from BBM2, BMN2, and BMN3 or the Ovule Development Protein 2 (ODP2) polypeptide is ODP2. In a further aspect, the nucleotide sequence encodes the functional WUS/WOX polypeptide and the Babyboom (BBM) polypeptide or the Ovule Development Protein 2 (ODP2) polypeptide. In a further aspect, the nucleotide sequence encoding the functional WUS/WOX polypeptide is selected from WUS1, WUS2, WUS3, WOX2 A, WOX4, WOX5, and WOX9 and the Babyboom (BBM) polypeptide is selected from BBM2, BMN2, and BMN3 or the Ovule Development Protein 2 (ODP2) polypeptide is ODP2. In a further aspect, the meiosis induction expression cassette comprises a product of a gene or genes produced from a DNA polynucleotide, a product of a gene or genes produced from a RNA polynucleotide, a product of a gene or genes as a protein or part of a protein complex, and a combination of the foregoing. In a further aspect, the gene or genes is selected from any of the sequences listed in Table 19, Table 20, Table 21, and combinations thereof. In a further aspect, the gene or genes selected from Table 19, Table 20, Table 21, and combinations thereof is a cyclin. In a further aspect, the cyclin comprises a cyclin with cyclin-dependent protein serine/threonine kinase regulator activity. In a further aspect, the cyclin regulates synapsis and recombination in prophase I during meiosis progression. In a further aspect, any of the sequences listed in Table 19, Table 20, Table 21, and combinations thereof is mutated to stimulate meiosis. In a further aspect, the bacterial-mediated delivery is provided by a Rhizobiales bacterial strain. In a further aspect, the Rhizobiales bacterial strain is selected from the group consisting of a disarmed *Agrobacterium*, an *Ochrobactrum* bacteria, and a Rhizobiaceae bacteria. In a further aspect, the first bacterial strain and the second bacterial strain are the same bacterial strain. In a further aspect, the same bacterial strain is selected from the group of a disarmed *Agrobacterium*, an *Ochrobactrum* bacteria, and a Rhizobiaceae bacteria. In a further aspect, the disarmed *Agrobacterium* is selected from the group of AGL-1, EHA105, GV3101, LBA4404, and LBA4404 THY-. In a further aspect, the *Ochrobactrum* bacteria is selected from Table 2. In a further aspect, the Rhizobiaceae bacteria is selected from Table 3. In a further aspect, the first bacterial strain and the second bacterial strain are different bacterial strains. In a further aspect, the different bacterial strains are selected from (i) a disarmed *Agrobacterium* and an *Ochrobactrum* bacteria; (ii) a disarmed *Agrobacterium* and a Rhizobiaceae bacteria; and (iii) a Rhizobiaceae bacteria and an *Ochrobactrum* bacteria. In a further aspect, the disarmed *Agrobacterium* is selected from the group of AGL-1, EHA105, GV3101, LBA4404, and LBA4404 THY-. In a further aspect, the *Ochrobactrum* bacteria is selected from Table 2. In a further aspect, the Rhizobiaceae bacteria is selected from Table 3. In a further aspect, the first bacterial strain and the second bacterial strain are present in a 50:50 ratio. In a further aspect, the first bacterial strain and the second bacterial strain are present in a 75:25 ratio. In a further aspect, the first bacterial strain and the second bacterial strain are present in a 90:10 ratio. In a further aspect, the first bacterial strain and the second bacterial strain are present in a 95:5 ratio. In a further aspect, the first bacterial strain and the second bacterial strain are present in a 99:1 ratio. In a further aspect, the exposing further comprises exposing the 2n embryo to a hypoxic environment, exposing the 2n embryo to a reducing agent at concentrations that lower the amount of reactive oxygen species in the 2n embryo, and combinations of the foregoing. In a further aspect, the hypoxic environment comprises an environment that contains less than 10% oxygen. In a further aspect, the hypoxic environment comprises an environment that contains less than 19.5 percent oxygen In a further aspect, the hypoxic environment is created by exposing the 2n embryo to a gas. In a further aspect, the hypoxic environment is created using non-atmospheric percentages of carbon dioxide and nitrogen relative to the percentage of oxygen. In a further aspect, the reducing agent is a liquid comprising a redox-modulatory compound. In a further aspect, the redox-modulatory compound is dissolved in the liquid. In a further aspect, the redox-modulatory compound is in a solid form and is contacted with the 2n embryo. In a further aspect, the redox-modulatory compound comprises a potassium iodide compound. In a further aspect, the redox-modulatory compound comprises a sodium nitroprusside compound.

The present disclosure provides a method of producing an artificial seed, comprising contacting a 2n embryo resulting from a biparental cross with a T-DNA containing a morphogenic gene expression cassette; collecting a clonal somatic embryo containing no morphogenic gene expression cassette; treating the collected clonal somatic embryo to acquire a mature embryo containing a morphogenic gene expression cassette; and, using the mature embryo to create an artificial seed.

The present disclosure provides a method for producing an artificial seed, comprising contacting a somatic embryo with a T-DNA containing a morphogenic gene expression cassette; collecting a clonal somatic embryo containing no morphogenic gene expression cassette; treating the clonal somatic embryo to acquire a mature embryo; and, using the mature embryo to create an artificial seed.

In a further aspect, the 2n embryo or the somatic embryo is an F1 hybrid or a BC1 resulting from a biparental cross. In a further aspect, the artificial seed is used for generating a clonal plant.

DETAILED DESCRIPTION

Figure 1:
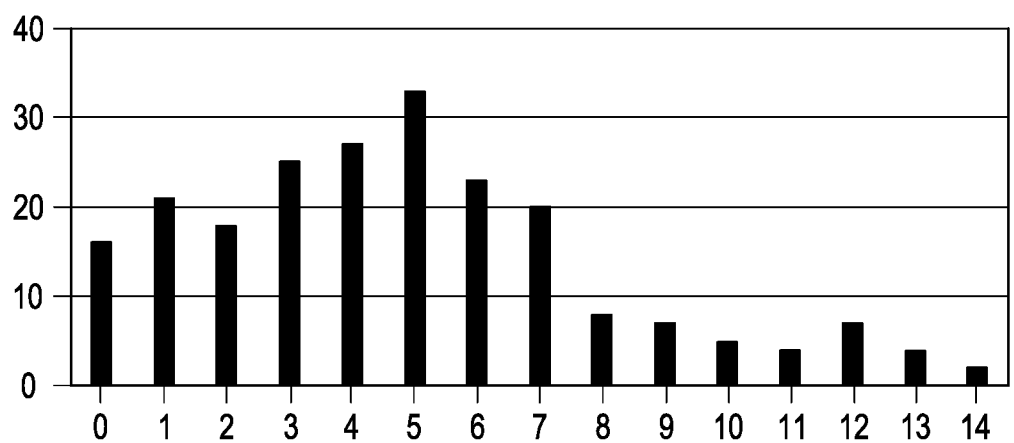
FIG. 1 shows the histogram distribution of regenerated plants per haploid embryo in response to using the RV020636 (SEQ ID NO: 186) plasmid as described in Example 5.

The disclosures herein will be described more fully hereinafter with reference to the accompanying figures, in which some, but not all possible aspects are shown. Indeed, disclosures may be embodied in many different forms and should not be construed as limited to the aspects set forth herein; rather, these aspects are provided so that this disclosure will satisfy applicable legal requirements.

Many modifications and other aspects disclosed herein will come to mind to one skilled in the art to which the disclosed methods pertain having the benefit of the teachings presented in the following descriptions and the associated figures. Therefore, it is to be understood that the disclosures are not to be limited to the specific aspects disclosed and that modifications and other aspects are intended to be included within the scope of the appended claims. Although specific terms are employed herein, they are used in a generic and descriptive sense only and not for purposes of limitation.

The terminology used herein is for the purpose of describing particular aspects only and is not intended to be limiting. As used in the specification and in the claims, the term "comprising" can include the aspect of "consisting of" Unless defined otherwise, all technical and scientific terms used herein have the same meaning as commonly understood by one of ordinary skill in the art to which the disclosed methods belong. In this specification and in the claims which follow, reference will be made to a number of terms which shall be defined herein.

The present disclosure comprises methods for producing non-transgenic and transgenic plants using a morphogenic gene. The present disclosure provides methods of producing non-transgenic plants by rapidly inducing somatic embryogenesis in wild type cells using a morphogenic gene. These methods are useful in plant breeding programs and in particular, in crop plants. For example, in maize the methods of the present disclosure improves the productivity of a maize maternal doubled haploid system, specifically by improving the regeneration of haploid plants per sampled haploid embryo. Due to attrition throughout the production process, haploid induction productivity under field conditions requires an average of fourteen (14) haploid embryos per doubled haploid line produced. The present disclosure provides methods of increasing productivity by producing produce multiple, clonal haploid plants from a haploid embryo.

The methods of the present disclosure are compatible with early genotyping of haploid plant cells while the cell are being cultured in vitro, thereby allowing the data outputs of these genotyping technologies to be used to predict the phenotypic performance for each plant cell genotype. This predictive selection provides the capability to design doubled haploid (DH) populations comprised of individuals with desirable genetic estimated breeding values in a manner that is expected to accelerate the rate of genetic gain relative to current breeding methods. The current state of the art is limited by the random selection of meiotic recombinants and the probability of recovering a superior outcome that is constrained by a relatively small number of recombinants allocated per DH population. The methods of the present disclosure permit early genotyping allowing the screening of more meiotic recombinants and facilitating the selection of candidates having the desired phenotypic/genotypic characteristics.

The methods of present disclosure provide a plant cell that is transformed with a morphogenic gene expression cassette expressing a morphogenic gene, thereby allowing the expressed morphogenic gene polypeptide to act upon cells that are not transformed during the transformation process. The methods of the present disclosure provide rapid induction of somatic embryogenesis in wild type cells in response to the activity of a translocated morphogenic gene polypeptide. The activity of a translocated morphogenic gene polypeptide in multiple cells can stimulate the development of multiple somatic embryos. The methods of the present disclosure are useful for generating multiple clonal embryos from a treated explant. When the treated explant is a maternal haploid embryo, the resulting clonal embryos can be contacted with a chromosome doubling agent to create multiple clonal doubled haploid plants per maternal haploid embryo.

The methods of the present disclosure improve productivity when used in plant breeding efforts by permitting the cross-fertilization of two individual plants derived from a common haploid embryo. This is particularly useful if flower development has shifted in the two respective plants, where one individual may be used as a pollen donor and the second as a pollen receiver, thereby allowing cross-fertilization within clones, As used herein, the term "morphogenic gene" means a gene that when ectopically expressed stimulates formation of a somatically-derived structure that can produce a plant. More precisely, ectopic expression of the morphogenic gene stimulates the de novo formation of a somatic embryo or an organogenic structure, such as a shoot meristem, that can produce a plant. This stimulated de novo formation occurs either in the cell in which the morphogenic gene is expressed, or in a neighboring cell. A morphogenic gene can be a transcription factor that regulates expression of other genes, or a gene that influences hormone levels in a plant tissue, both of which can stimulate morphogenic changes. As used herein, the term "morphogenic factor" means a morphogenic gene and/or the protein expressed by a morphogenic gene.

A morphogenic gene is involved in plant metabolism, organ development, stem cell development, cell growth stimulation, organogenesis, somatic embryogenesis initiation, accelerated somatic embryo maturation, initiation and/or development of the apical meristem, initiation and/or development of shoot meristem, or a combination thereof, such as WUS/WOX genes (WUS1, WUS2, WUS3, WOX2 A, WOX4, WOX5, or WOX9) see, U.S. Pat. Nos. 7,348,468 and 7,256,322 and US Patent Application Publication Numbers 2017/0121722 and 2007/0271628, herein incorporated by reference in their entirety; Laux et al. (1996) Development 122:87-96; and Mayer et al. (1998) Cell 95:805-815; van der Graaff et al., 2009, Genome Biology 10:248; Dolzblasz et al., 2016, Mol. Plant 19:1028-39. Modulation of WUS/WOX is expected to modulate plant and/or plant tissue phenotype including plant metabolism, organ development, stem cell development, cell growth stimulation, organogenesis, somatic embryogenesis initiation, accelerated somatic embryo maturation, initiation and/or development of the apical meristem, initiation and/or development of shoot meristem, or a combination thereof. Expression of Arabidopsis WUS can induce stem cells in vegetative tissues, which can differentiate into somatic embryos (Zuo, et al. (2002) Plant J 30:349-359). Also of interest in this regard would be a MYB118 gene (see U.S. Pat. No. 7,148,402), MYB115 gene (see Wang et al. (2008) Cell Research 224-235), a BABYBOOM gene (BBM; see Boutilier et al. (2002) Plant Cell 14:1737-1749), or a CLAVATA gene (see, for example, U.S. Pat. No. 7,179,963).

Morphogenic polynucleotide sequences and amino acid sequences of WUS/WOX homeobox polypeptides are useful in the disclosed methods. As defined herein, a "functional WUS/WOX nucleotide" is any polynucleotide encoding a protein that contains a homeobox DNA binding domain, a WUS box, and an EAR repressor domain (Ikeda et al., 2009 Plant Cell 21:3493-3505). As demonstrated by Rodriguez et al., 2016 PNAS www.pnas.org/cgi/doi/10.1073/pnas.1607673113 removal of the dimerization sequence which leaves behind the homeobox DNA binding domain, a WUS box, and an EAR repressor domain results in a functional WUS/WOX polypeptide. The Wuschel protein, designated hereafter as WUS, plays a key role in the initiation and maintenance of the apical meristem, which contains a pool of pluripotent stem cells (Endrizzi, et al., (1996) Plant Journal 10:967-979; Laux, et al., (1996) Development 122:87-96; and Mayer, et al., (1998) Cell 95:805-815). Arabidopsis plants mutant for the WUS gene contain stem cells that are misspecified and that appear to undergo differentiation. WUS encodes a novel homeodomain protein which presumably functions as a transcriptional regulator (Mayer, et al., (1998) Cell 95:805-815). The stem cell population of Arabidopsis shoot meristems is believed to be maintained by a regulatory loop between the CLAVATA (CLV) genes which promote organ initiation and the WUS gene which is required for stem cell identity, with the CLV genes repressing WUS at the transcript level, and WUS expression being sufficient to induce meristem cell identity and the expression of the stem cell marker CLV3 (Brand, et al., (2000) Science 289:617-619; Schoof, et al., (2000) Cell 100:635-644). Constitutive expression of WUS in Arabidopsis has been shown to lead to adventitious shoot proliferation from leaves (in planta) (Laux, T., Talk Presented at the XVI International Botanical Congress Meeting, Aug. 1-7, 1999, St. Louis, Mo.).

In an aspect, the WUS/WOX homeobox polypeptide useful in the methods of the present disclosure is a WUS1, WUS2, WUS3, WOX2 A, WOX4, WOX5, WOX5 A, or WOX9 polypeptide (see, U.S. Pat. Nos. 7,348,468 and 7,256,322 and US Patent Application Publication Numbers 2017/0121722 and 2007/0271628, herein incorporated by reference in their entirety and van der Graaff et al., 2009, Genome Biology 10:248). The WUS/WOX homeobox polypeptide useful in the methods of the present disclosure can be obtained from or derived from any of the plants described herein. Additional WUS/WOX genes useful in the methods of the present disclosure are listed in Table 1 below.

TABLE 1

| SEQ ID NO: | Polynucleotide (DNA) or Polypeptide (PRT) | Name | Description |
| --- | --- | --- | --- |
| 1 | DNA | AT-WUS | Arabidopsis thaliana WUS coding sequence |
| 2 | PRT | AT-WUS | Arabidopsis thaliana WUS protein sequence |
| 3 | DNA | LJ-WUS | Lotus japonicus WUS coding sequence |
| 4 | PRT | LJ-WUS | Lotus japonicus WUS protein sequence |
| 5 | DNA | GM-WUS | Glycine max WUS coding sequence |
| 6 | PRT | GM-WUS | Glycine max WUS protein sequence |
| 7 | DNA | CS-WUS | Camelina sativa WUS coding sequence |
| 8 | PRT | CS-WUS | Camelina sativa WUS protein sequence |
| 9 | DNA | CR-WUS | Capsella rubella WUS coding sequence |
| 10 | PRT | CR-WUS | Capsella rubella WUS protein sequence |
| 11 | DNA | AA-WUS | Arabis alpina WUS coding sequence |
| 12 | PRT | AA-WUS | Arabis alpina WUS protein sequence |
| 13 | DNA | RS-WUS | Raphanus sativus WUS coding sequence |
| 14 | PRT | RS-WUS | Raphanus sativus WUS protein sequence |
| 15 | DNA | BN-WUS | Brassica napus WUS coding sequence |
| 16 | PRT | BN-WUS | Brassica napus WUS protein sequence |
| 17 | DNA | BO-WUS | Brassica oleracea var. oleracea WUS coding sequence |
| 18 | PRT | BO-WUS | Brassica oleracea var. oleracea WUS protein sequence |

TABLE 1-continued

| SEQ ID NO: | Polynucleotide (DNA) or Polypeptide (PRT) | Name | Description |
|---|---|---|---|
| 19 | DNA | HA-WUS | Helianthus annuus WUS coding sequence |
| 20 | PRT | HA-WUS | Helianthus annuus WUS protein sequence |
| 21 | DNA | PT-WUS | Populus trichocarpa WUS coding sequence |
| 22 | PRT | PT-WUS | Populus trichocarpa WUS protein sequence |
| 23 | DNA | VV-WUS | Vitus vinifera WUS coding sequence |
| 24 | PRT | VV-WUS | Vitus vinifera WUS protein sequence |
| 25 | DNA | AT-WUS | Arabidopsis thaliana WUS coding sequence (soy optimized) |
| 26 | PRT | AT-WUS | Arabidopsis thaliana WUS protein sequence |
| 27 | DNA | LJ-WUS | Lotus japonicus WUS coding sequence (soy optimized) |
| 28 | PRT | LJ-WUS | Lotus japonicus WUS protein sequence |
| 29 | DNA | MT-WUS | Medicago truncatula WUS coding sequence (soy optimized) |
| 30 | PRT | MT-WUS | Medicago truncatula WUS protein sequence |
| 31 | DNA | PY-WUS | Petunia hybrida WUS coding sequence (soy optimized) |
| 32 | PRT | PY-WUS | Petunia hybrida WUS protein sequence |
| 33 | DNA | PV-WUS | Phaseolus vulgaris WUS coding sequence (soy optimized) |
| 34 | PRT | PV-WUS | Phaseolus vulgaris WUS protein sequence |

Other morphogenic genes useful in the present disclosure include, but are not limited to, LEC1 (U.S. Pat. No. 6,825,397 incorporated herein by reference in its entirety, Lotan et al., 1998, Cell 93:1195-1205), LEC2 (Stone et al., 2008, PNAS 105:3151-3156; Belide et al., 2013, Plant Cell Tiss. Organ Cult 113:543-553), KN1/STM (Sinha et al., 1993, Genes Dev 7:787-795), the IPT gene from *Agrobacterium* (Ebinuma and Komamine, 2001, In vitro Cell. Dev Biol—Plant 37:103-113), MONOPTEROS-DELTA (Ckurshumova et al., 2014, New Phytol. 204:556-566), the *Agrobacterium* AV-6b gene (Wabiko and Minemura 1996, Plant Physiol. 112:939-951), the combination of the *Agrobacterium* IAA-h and IAA-m genes (Endo et al., 2002, Plant Cell Rep., 20:923-928), the *Arabidopsis* SERK gene (Hecht et al., 2001, Plant Physiol. 127:803-816), the *Arabidopsis* AGL15 gene (Harding et al., 2003, Plant Physiol. 133:653-663), the *FUSCA* gene (Castle and Meinke, Plant Cell 6:25-41), and the PICKLE gene (Ogas et al., 1999, PNAS 96:13839-13844).

As used herein, the term "expression cassette" means a distinct component of vector DNA consisting of coding and non-coding sequences including 5' and 3' regulatory sequences that control expression in a transformed/transfected cell.

As used herein, the term "coding sequence" means the portion of DNA sequence bounded by a start and a stop codon that encodes the amino acids of a protein.

As used herein, the term "non-coding sequence" means the portions of a DNA sequence that are transcribed to produce a messenger RNA, but that do not encode the amino acids of a protein, such as 5' untranslated regions, introns and 3' untranslated regions. Non-coding sequence can also refer to RNA molecules such as micro-RNAs, interfering RNA or RNA hairpins, that when expressed can down-regulate expression of an endogenous gene or another transgene.

As used herein, the term "regulatory sequence" means a segment of a nucleic acid molecule which is capable of increasing or decreasing the expression of a gene. Regulatory sequences include promoters, terminators, enhancer elements, silencing elements, 5' UTR and 3' UTR (untranslated region).

As used herein, the term "transfer cassette" means a T-DNA comprising an expression cassette or expression cassettes flanked by the right border and the left border.

As used herein, the term "T-DNA" means a portion of a Ti plasmid that is inserted into the genome of a host plant cell.

As used herein, the term "embryo" means embryos and progeny of the same, immature and mature embryos, immature zygotic embryo, zygotic embryos, somatic embryos, embryogenic callus, and embryos derived from mature ear-derived seed. An embryo is a structure that is capable of germinating to form a plant.

As used herein, the term "1n cell" means a cell containing a single set of chromosomes, typically the product of meiosis. Examples of a 1n cell include gametes such as sperm cells, egg cells, or tissues derived from a gamete through mitotic divisions, such as a 1n embryo or a 1n plant. In corn where the plant is normally diploid, and the gametes are haploid, such gamete-derived embryos or plants are referred to as haploid embryos and haploid plants.

As used herein, the term "2n cell" means a cell containing two sets of chromosomes. Examples of 2n cells include a zygote, an embryo resulting from mitotic divisions of a zygote, or a plant produced by germination of a 2n embryo.

As used herein, the term "haploid plant" or "haploid" means a plant having a single set (genome) of chromosomes and the reduced number of chromosomes (n) in the haploid plant is equal to that in the gamete.

As used herein, the term "diploid plant" means a plant having two sets (genomes) of chromosomes and the chromosome number (2n) is equal to that in the zygote.

As used herein, the term "doubled haploid" or "doubled haploid plant" or "doubled haploid cell" means one that is developed by the doubling of a haploid set of chromosomes. A plant or seed that is obtained from a doubled haploid plant that is selfed any number of generations is still identified as a doubled haploid plant. A doubled haploid plant is considered a homozygous plant. A plant is considered a doubled haploid if it is fertile, even if the entire vegetative part of the plant does not consist of the cells with the doubled set of chromosomes. For example, a plant will be considered a doubled haploid plant if it contains viable gametes, even if the plant is chimeric.

As used herein, the term "doubled haploid embryo" means an embryo that has one or more cells containing two (2) sets of homozygous chromosomes that can then be grown into a doubled haploid plant.

As used herein, the term "clonal" means multiple propagated plant cells or plants that are genetically, epigenetically and morphologically identical.

As used herein, the term "gamete" means a 1n reproductive cell such as a sperm cell, an egg cell or an ovule cell resulting from meiosis.

As used herein, the term "haploid embryo" means a gamete-derived somatic structure.

As used herein, the term "somatic structure" means a tissue, organ or organism.

As used herein, the term "somatic cell" is a cell that is not a gamete. Somatic cells, tissues or plants can be haploid, diploid, triploid, tetraploid, hexaploid, etc. A complete set of chromosomes is referred to as being 1n (haploid), with the number of chromosomes found in a single set of chromosomes being referred to as the monoploid number (x). For example, in the diploid plant Zea mays, 2n=2x=20 total chromosomes, while in diploid rice Oryza sativa, 2n=2x=24 total chromosomes. In a triploid plant, such as banana, 2n=3x=33 total chromosomes. In hexaploid wheat Triticum aestivum, 2n=6x=42. Ploidy levels can also vary between cultivars within the same species, such as in sugarcane, Saccharum officinarum, where 2n=10x=80 chromosomes, but commercial sugarcane varieties range from 100 to 130 chromosomes.

As used herein, the term "anther" means a part of the stamen containing the microsporangia that is attached to the filament As used herein, the term "locule" means a compartment within anthers containing the male gametes during microgametogenesis.

As used herein, the term "microgametogenesis" means the process in plant reproduction where a macrogametophyte, herein called "microspores", develops in a pollen grain to the three-celled stage of its development.

As used herein, the term "microsporangium (plural microsporangia)" means a sporangium that produces spores that give rise to male gametophytes. In nearly all land plants, sporangia are the site of meiosis and produce genetically distinct haploid spores.

As used herein, the term "microspore embryogenesis" means the activation of androgenic embryogenesis using microspores.

As used herein, the term "microspore-derived embryo" or "embryoid" or "embryo-like structure" means a cell or cells derived from a microspore with a cell fate and development characteristic of cells undergoing embryogenesis.

As used herein, the term "androgenic" means induction of androgenesis, for example, parthenogenesis in which the embryo contains only paternal chromosomes for haploid or diploid cells.

As used herein, the term "contacting", "comes in contact with" or "in contact with" mean "direct contact" or "indirect contact". For example, the medium comprising a doubling agent may have "direct contact" with a haploid cell or the medium comprising a doubling agent may be separated from a haploid cell by filter paper, plant tissues, or other cells, thus the doubling agent has "indirect contact" with the haploid cell and is transferred through the filter paper, plant tissues or other cells to the haploid cell.

As used herein, the term "biparental cross" is the cross-fertilization of two genetically different plants to obtain the first filial generation of offspring and/or any successive filial generation thereafter. As used herein a biparental cross includes the offspring that are the progeny of any filial generation of offspring, including cross-fertilizing an offspring to one of its parental lines or an individual genetically like its parent to obtain progeny with a genetic identity closer to that of the parent referred to as a "backcross" and/or any successive backcross generation thereafter.

As used herein, the term "medium" includes compounds in liquid, gas, or solid states.

As used herein, the term "selectable marker" means a transgene that when expressed in a transformed/transfected cell confers resistance to selective agents such as antibiotics, herbicides and other compounds toxic to an untransformed/untransfected cell.

As used herein, the term "EAR" means an "Ethylene-responsive element binding factor-associated Amphiphilic Repression motif" with a general consensus sequence of LLxLxL, DNLxxP, LxLxPP, R/KLFGV, or TLLLFR that act as transcriptional repression signals within transcription factors. Addition of an EAR-type repressor element to a DNA-binding protein such as a transcription factor, dCAS9, or LEXA (as examples) confers transcriptional repression function to the fusion protein (Kagale, S., and Rozwadowski, K. 2010. Plant Signaling and Behavior 5:691-694).

As used herein, the term "transcription factor" means a protein that controls the rate of transcription of specific genes by binding to the DNA sequence of the promoter and either up-regulating or down-regulating expression. Examples of transcription factors, which are also morphogenic genes, include members of the AP2/EREBP family (including the BBM (ODP2), plethora and ainteguments sub-families, CAAT-box binding proteins such as LEC1 and HAP3, and members of the MYB, bHLH, NAC, MADS, bZIP and WRKY families.

Morphogenic polynucleotide sequences and amino acid sequences of Ovule Development Protein 2 (ODP2) polypeptides, and related polypeptides, e.g., Babyboom (BBM) protein family proteins are useful in the methods of the present disclosure. In an aspect, a polypeptide comprising two AP2-DNA binding domains is an ODP2, BBM2, BMN2, or BMN3 polypeptide see, US Patent Application Publication Number 2017/0121722, herein incorporated by reference in its entirety. ODP2 polypeptides useful in the methods of the present disclosure contain two predicted APETALA2 (AP2) domains and are members of the AP2 protein family (PFAM Accession PF00847). The AP2 family of putative transcription factors has been shown to regulate a wide range of developmental processes, and the family members are characterized by the presence of an AP2 DNA binding domain. This conserved core is predicted to form an amphipathic alpha helix that binds DNA. The AP2 domain was first identified in APETALA2, an Arabidopsis protein that regulates meristem identity, floral organ specification, seed coat development, and floral homeotic gene expression. The AP2 domain has now been found in a variety of proteins.

ODP2 polypeptides useful in the methods of the present disclosure share homology with several polypeptides within the AP2 family, e.g., see FIG. 1 of U.S. Pat. No. 8,420,893, which is incorporated herein by reference in its entirety, provides an alignment of the maize and rice ODP2 polypeptides with eight other proteins having two AP2 domains. A consensus sequence of all proteins appearing in the alignment of U.S. Pat. No. 8,420,893 is also provided in FIG. 1 therein. The polypeptide comprising the two AP2-DNA binding domains useful in the methods of the present disclosure can be obtained from or derived from any of the plants described herein. In an aspect, the polypeptide comprising the two AP2-DNA binding domains useful in the methods of the present disclosure is an ODP2 polypeptide. In an aspect, the polypeptide comprising the two AP2-DNA binding domains useful in the methods of the present disclosure is a BBM2 polypeptide. The ODP2 polypeptide and the BBM2 polypeptide useful in the methods of the present disclosure can be obtained from or derived from any of the plants described herein.

A morphogenic gene may be stably incorporated into the genome of a plant or it may be transiently expressed. In an aspect, expression of the morphogenic gene is controlled. The controlled expression may be a pulsed expression of the morphogenic gene for a particular period of time. Alternatively, the morphogenic gene may be expressed in only some transformed cells and not expressed in others. The control of expression of the morphogenic gene can be achieved by a variety of methods as disclosed herein below. The morphogenic genes useful in the methods of the present disclosure may be obtained from or derived from any plant species described herein.

The term "plant" refers to whole plants, plant organs (e.g., leaves, stems, roots, etc.), plant tissues, plant cells, plant parts, seeds, propagules, embryos and progeny of the same. Plant cells can be differentiated or undifferentiated (e.g. callus, undifferentiated callus, immature and mature embryos, immature zygotic embryo, immature cotyledon, embryonic axis, suspension culture cells, protoplasts, leaf, leaf cells, root cells, phloem cells and pollen). Plant cells include, without limitation, cells from seeds, suspension cultures, explants, immature embryos, embryos, zygotic embryos, somatic embryos, embryogenic callus, meristem, somatic meristems, organogenic callus, protoplasts, embryos derived from mature ear-derived seed, leaf bases, leaves from mature plants, leaf tips, immature inflorescences, tassel, immature ear, silks, cotyledons, immature cotyledons, meristematic regions, callus tissue, cells from leaves, cells from stems, cells from roots, cells from shoots, gametophytes, sporophytes, pollen, microspores, multicellular structures (MCS), and embryo-like structures. Plant parts include differentiated and undifferentiated tissues including, but not limited to, roots, stems, shoots, leaves, pollen, seeds, tumor tissue and various forms of cells in culture (e. g., single cells, protoplasts, embryos, and callus tissue). The plant tissue may be in a plant or in a plant organ, tissue, or cell culture. Grain is intended to mean the mature seed produced by commercial growers for purposes other than growing or reproducing the species. Progeny, variants and mutants of the regenerated plants are also included within the scope of the present disclosure, provided these progeny, variants and mutants comprise the introduced polynucleotides.

The present disclosure may be used for transformation of any plant species, including, but not limited to, monocots and dicots. Monocots include, but are not limited to, barley, maize (corn), millet (e.g., pearl millet (*Pennisetum glaucum*), proso millet (*Panicum miliaceum*), foxtail millet (*Setaria italica*), finger millet (*Eleusine coracana*), teff (*Eragrostis tef*), oats, rice, rye, *Setaria* sp., sorghum, triticale, or wheat, or leaf and stem crops, including, but not limited to, bamboo, marram grass, meadow-grass, reeds, ryegrass, sugarcane; lawn grasses, ornamental grasses, and other grasses such as switchgrass and turf grass. Alternatively, dicot plants used in the present disclosure, include, but are not limited to, kale, cauliflower, broccoli, mustard plant, cabbage, pea, clover, alfalfa, broad bean, tomato, peanut, cassava, soybean, canola, alfalfa, sunflower, safflower, tobacco, *Arabidopsis*, or cotton.

Examples of plant species of interest include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (Carthamus tinctorius), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (Citrus spp.), cocoa (*Theobroma cacao*), tea (*Camellia sinensis*), banana (Musa spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (Macadamia *integrifolia*), almond (*Prunus amygdalus*), sugar beets (*Beta vulgaris*), sugarcane (*Saccharum* spp.), oats, barley, vegetables, ornamentals, and conifers.

In specific aspects, plants transformed by the methods of the present disclosure are crop plants (for example, corn, alfalfa, sunflower, *Brassica*, soybean, cotton, safflower, peanut, rice, sorghum, wheat, millet, tobacco, etc.). Plants of particular interest include grain plants that provide seeds of interest, oil-seed plants, and leguminous plants. Seeds of interest include grain seeds, such as corn, wheat, barley, rice, sorghum, rye, etc. Oil-seed plants include cotton, soybean, safflower, sunflower, *Brassica*, maize, alfalfa, palm, coconut, etc. Leguminous plants include, but are not limited to, beans and peas. Beans include, but are not limited to, guar, locust bean, fenugreek, soybean, garden beans, cowpea, mungbean, lima bean, fava bean, lentils, and chickpea.

The present disclosure also includes plants obtained by any of the disclosed methods herein. The present disclosure also includes seeds from a plant obtained by any of the disclosed methods herein. A transgenic plant is defined as a mature, fertile plant that contains a transgene.

In the disclosed methods, various plant-derived explants can be used, including immature embryos, 1-5 mm zygotic embryos, 3-5 mm embryos, and embryos derived from mature ear-derived seed, leaf bases, leaves from mature plants, leaf tips, immature inflorescences, tassel, immature ear, and silks. In an aspect, the explants used in the disclosed methods can be derived from mature ear-derived seed, leaf bases, leaves from mature plants, leaf tips, immature inflorescences, tassel, immature ear, and silks. The explant used in the disclosed methods can be derived from any of the plants described herein.

The present disclosure encompasses isolated or substantially purified nucleic acid compositions. An "isolated" or "purified" nucleic acid molecule or protein or a biologically active portion thereof is substantially free of other cellular material or components that normally accompany or interact with the nucleic acid molecule or protein as found in its naturally occurring environment or is substantially free of culture medium when produced by recombinant techniques or substantially free of chemical precursors or other chemicals when chemically synthesized. An "isolated" nucleic acid is substantially free of sequences (including protein encoding sequences) that naturally flank the nucleic acid (i.e., sequences located at the 5' and 3' ends of the nucleic acid) in the genomic DNA of the organism from which the nucleic acid is derived. For example, in various aspects, an isolated nucleic acid molecule can contain less than about 5 kb, 4 kb, 3 kb, 2 kb, 1 kb, 0.5 kb or 0.1 kb of nucleotide sequences that naturally flank the nucleic acid molecule in genomic DNA of the cell from which the nucleic acid is derived. A protein that is substantially free of cellular material includes preparations of protein having less than about 30%, 20%, 10%, 5%, or 1% (by dry weight) of contaminating protein. When a protein useful in the methods of the present disclosure or biologically active portion thereof is recombinantly produced, optimally culture medium represents less than about 30%, 20%, 10%, 5%, or 1% (by dry weight) of chemical precursors or non-protein-of-interest chemicals. Sequences useful in the methods of the present disclosure may be isolated from the 5' untranslated region flanking their respective transcription initiation sites. The present disclosure encompasses isolated or substantially purified nucleic acid or protein compositions useful in the methods of the present disclosure.

As used herein, the term "fragment" refers to a portion of the nucleic acid sequence. Fragments of sequences useful in the methods of the present disclosure retain the biological activity of the nucleic acid sequence. Alternatively, fragments of a nucleotide sequence that are useful as hybridization probes may not necessarily retain biological activity. Fragments of a nucleotide sequence disclosed herein may range from at least about 20, 25, 50, 75, 100, 125, 150, 175, 200, 225, 250, 275, 300, 325, 350, 375, 400, 425, 450, 475, 500, 525, 550, 575, 600, 625, 650, 675, 700, 725, 750, 775, 800, 825, 850, 875, 900, 925, 950, 975, 1000, 1025, 1050, 1075, 1100, 1125, 1150, 1175, 1200, 1225, 1250, 1275, 1300, 1325, 1350, 1375, 1400, 1425, 1450, 1475, 1500, 1525, 1550, 1575, 1600, 1625, 1650, 1675, 1700, 1725, 1750, 1775, 1800, 1825, 1850, 1875, or 1900 nucleotides, and up to the full length of the subject sequence. A biologically active portion of a nucleotide sequence can be prepared by isolating a portion of the sequence and assessing the activity of the portion.

Fragments and variants of nucleotide sequences and the proteins encoded thereby useful in the methods of the present disclosure are also encompassed. As used herein, the term "fragment" refers to a portion of a nucleotide sequence and hence the protein encoded thereby or a portion of an amino acid sequence. Fragments of a nucleotide sequence may encode protein fragments that retain the biological activity of the native protein. Alternatively, fragments of a nucleotide sequence useful as hybridization probes generally do not encode fragment proteins retaining biological activity. Thus, fragments of a nucleotide sequence may range from at least about 20 nucleotides, about 50 nucleotides, about 100 nucleotides, and up to the full-length nucleotide sequence encoding the proteins useful in the methods of the present disclosure.

As used herein, the term "variants" is means sequences having substantial similarity with a sequence disclosed herein. A variant comprises a deletion and/or addition of one or more nucleotides or peptides at one or more internal sites within the native polynucleotide or polypeptide and/or a substitution of one or more nucleotides or peptides at one or more sites in the native polynucleotide or polypeptide. For polynucleotides, conservative variants include those sequences that, because of the degeneracy of the genetic code, encode the amino acid sequence of one of the morphogenic genes and/or genes/polynucleotides of interest disclosed herein. Variant polynucleotides also include synthetically derived polynucleotides, such as those generated, for example, by using site-directed mutagenesis but which still encode a protein of a morphogenic gene and/or gene/polynucleotide of interest disclosed herein. Generally, variants of a particular morphogenic gene and/or gene/polynucleotide of interest disclosed herein will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to that particular morphogenic gene and/or gene/polynucleotide of interest as determined by sequence alignment programs and parameters described elsewhere herein.

As used herein, a "native" nucleotide or peptide sequence comprises a naturally occurring nucleotide or peptide sequence, respectively. For nucleotide sequences, naturally occurring variants can be identified with the use of well-known molecular biology techniques, such as, for example, with polymerase chain reaction (PCR) and hybridization techniques as outlined herein. A biologically active variant of a protein useful in the methods of the present disclosure may differ from that native protein by as few as 1-15 amino acid residues, as few as 1-10, such as 6-10, as few as 5, as few as 4, 3, 2, or even 1 amino acid residue.

Variant nucleotide sequences also include synthetically derived nucleotide sequences, such as those generated, for example, by using site-directed mutagenesis. Generally, variants of a nucleotide sequence disclosed herein will have at least 40%, 50%, 60%, 65%, 70%, 75%, 80%, 85%, 90%, 91%, 92%, 93%, 94%, to 95%, 96%, 97%, 98%, 99% or more sequence identity to that nucleotide sequence as determined by sequence alignment programs described elsewhere herein using default parameters. Biologically active variants of a nucleotide sequence disclosed herein are also encompassed. Biological activity may be measured by using techniques such as Northern blot analysis, reporter activity measurements taken from transcriptional fusions, and the like. See, for example, Sambrook, et al., (1989) Molecular Cloning: A Laboratory Manual (2d ed., Cold Spring Harbor Laboratory Press, Cold Spring Harbor, N.Y.), hereinafter "Sambrook," herein incorporated by reference in its entirety. Alternatively, levels of a reporter gene such as green fluorescent protein (GFP) or yellow fluorescent protein (YFP) or the like produced under the control of a promoter operably linked to a nucleotide fragment or variant can be measured. See, for example, Matz et al. (1999) Nature Biotechnology 17:969-973; U.S. Pat. No. 6,072,050, herein incorporated by reference in its entirety; Nagai, et al., (2002) Nature Biotechnology 20(1):87-90. Variant nucleotide sequences also encompass sequences derived from a mutagenic and recombinogenic procedure such as DNA shuffling. With such a procedure, one or more different nucleotide sequences can be manipulated to create a new nucleotide sequence. In this manner, libraries of recombinant polynucleotides are generated from a population of related sequence polynucleotides comprising sequence regions that have substantial sequence identity and can be homologously recombined in vitro or in vivo. Strategies for such DNA shuffling are known in the art. See, for example, Stemmer, (1994) Proc. Natl. Acad. Sci. USA 91:10747-10751; Stemmer, (1994) Nature 370:389 391; Crameri, et al., (1997) Nature Biotech. 15:436-438; Moore, et al., (1997) J. Mol. Biol. 272:336-347; Zhang, et al., (1997) Proc. Natl. Acad. Sci. USA 94:4504-4509; Crameri, et al., (1998) Nature 391:288-291 and U.S. Pat. Nos. 5,605,793 and 5,837,458, herein incorporated by reference in their entirety.

Methods for mutagenesis and nucleotide sequence alterations are well known in the art. See, for example, Kunkel, (1985) Proc. Natl. Acad. Sci. USA 82:488-492; Kunkel, et al., (1987) Methods in Enzymol. 154:367-382; U.S. Pat. No. 4,873,192; Walker and Gaastra, eds. (1983) Techniques in Molecular Biology (MacMillan Publishing Company, New York) and the references cited therein, herein incorporated by reference in their entirety. Guidance as to appropriate amino acid substitutions that do not affect biological activity of the protein of interest may be found in the model of Dayhoff et al. (1978) Atlas of Protein Sequence and Structure (Natl. Biomed. Res. Found., Washington, D.C.), herein incorporated by reference. Conservative substitutions, such as exchanging one amino acid with another having similar properties, may be optimal.

The nucleotide sequences of the present disclosure can be used to isolate corresponding sequences from other organisms, particularly other plants, more particularly other monocots or dicots. In this manner, methods such as PCR, hybridization and the like can be used to identify such sequences based on their sequence homology to the sequences set forth herein. Sequences isolated based on their sequence identity to the entire sequences set forth herein or to fragments thereof are encompassed by the present disclosure.

In a PCR approach, oligonucleotide primers can be designed for use in PCR reactions to amplify corresponding DNA sequences from cDNA or genomic DNA extracted from any plant of interest. Methods for designing PCR primers and PCR cloning are generally known in the art and are disclosed in, Sambrook, supra. See also, Innis, et al., eds. (1990) PCR Protocols: A Guide to Methods and Applications (Academic Press, New York); Innis and Gelfand, eds. (1995) PCR Strategies (Academic Press, New York); and Innis and Gelfand, eds. (1999) PCR Methods Manual (Academic Press, New York), herein incorporated by reference in their entirety. Known methods of PCR include, but are not limited to, methods using paired primers, nested primers, single specific primers, degenerate primers, gene-specific primers, vector-specific primers, partially-mismatched primers and the like.

In hybridization techniques, all or part of a known nucleotide sequence is used as a probe that selectively hybridizes to other corresponding nucleotide sequences present in a population of cloned genomic DNA fragments or cDNA fragments (i.e., genomic or cDNA libraries) from a chosen organism. The hybridization probes may be genomic DNA fragments, cDNA fragments, RNA fragments, or other oligonucleotides and may be labeled with a detectable group such as 32P or any other detectable marker. Thus, for example, probes for hybridization can be made by labeling synthetic oligonucleotides based on the sequences of the present disclosure. Methods for preparation of probes for hybridization and for construction of genomic libraries are generally known in the art and are disclosed in Sambrook, supra.

In general, sequences that have activity and hybridize to the sequences disclosed herein will be at least 40% to 50% homologous, about 60%, 70%, 80%, 85%, 90%, 95% to 98% homologous or more with the disclosed sequences. That is, the sequence similarity of sequences may range, sharing at least about 40% to 50%, about 60% to 70%, and about 80%, 85%, 90%, 95% to 98% sequence similarity.

Methods of alignment of sequences for comparison are well known in the art. Thus, the determination of percent sequence identity between any two sequences can be accomplished using a mathematical algorithm. Non-limiting examples of such mathematical algorithms are the algorithm of Myers and Miller, (1988) CABIOS 4:11-17; the algorithm of Smith, et al., (1981) Adv. Appl. Math. 2:482; the algorithm of Needleman and Wunsch, (1970) J. Mol. Biol. 48:443-453; the algorithm of Pearson and Lipman, (1988) Proc. Natl. Acad. Sci. 85:2444-2448; the algorithm of Karlin and Altschul, (1990) Proc. Natl. Acad. Sci. USA 872:264, modified as in Karlin and Altschul, (1993) Proc. Natl. Acad. Sci. USA 90:5873-5877, herein incorporated by reference in their entirety. Computer implementations of these mathematical algorithms are well known in the art and can be utilized for comparison of sequences to determine sequence identity.

As used herein, "sequence identity" or "identity" in the context of two nucleic acid or polypeptide sequences refers to the residues in the two sequences that are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. When sequences differ in conservative substitutions, the percent sequence identity may be adjusted upwards to correct for the conservative nature of the substitution. Sequences that differ by such conservative substitutions are said to have "sequence similarity" or "similarity". Means for making this adjustment are well known to those of skill in the art. Typically, this involves scoring a conservative substitution as a partial rather than a full mismatch, thereby increasing the percentage sequence identity. Thus, for example, where an identical amino acid is given a score of one and a non-conservative substitution is given a score of zero, a conservative substitution is given a score between zero and one. The scoring of conservative substitutions is calculated, e.g., as implemented in the program PC/GENE (Intelligenetics, Mountain View, Calif.).

As used herein, "percentage of sequence identity" means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity.

The term "substantial identity" of polynucleotide sequences means that a polynucleotide comprises a sequence that has at least 70% sequence identity, optimally at least 80%, more optimally at least 90% and most optimally at least 95%, compared to a reference sequence using an alignment program using standard parameters. One of skill in the art will recognize that these values can be appropriately adjusted to determine corresponding identity of proteins encoded by two nucleotide sequences by considering codon degeneracy, amino acid similarity, reading frame positioning and the like. Substantial identity of amino acid sequences for these purposes normally means sequence identity of at least 60%, 70%, 80%, 90% and at least 95%.

Another indication that nucleotide sequences are substantially identical is if two molecules hybridize to each other under stringent conditions. Generally, stringent conditions are selected to be about 5° C. lower than the Tm for the specific sequence at a defined ionic strength and pH. However, stringent conditions encompass temperatures in the range of about 1° C. to about 20° C. lower than the Tm, depending upon the desired degree of stringency as otherwise qualified herein. Nucleic acids that do not hybridize to each other under stringent conditions are still substantially identical if the polypeptides they encode are substantially identical. This may occur, e.g., when a copy of a nucleic acid is created using the maximum codon degeneracy permitted by the genetic code. One indication that two nucleic acid sequences are substantially identical is when the polypeptide encoded by the first nucleic acid is immunologically cross reactive with the polypeptide encoded by the second nucleic acid.

The sequences and genes disclosed herein, as well as variants and fragments thereof, are useful for the genetic engineering of plants, e.g. to produce a transformed or transgenic plant, to express a phenotype of interest. As used herein, the terms "transformed plant" and "transgenic plant" refer to a plant that comprises within its genome a heterologous polynucleotide. Generally, the heterologous polynucleotide is stably integrated within the genome of a transgenic or transformed plant such that the polynucleotide is passed on to successive generations. The heterologous polynucleotide may be integrated into the genome alone or as part of a recombinant DNA construct. It is to be understood that as used herein the term "transgenic" includes any cell, cell line, callus, tissue, plant part or plant the genotype of which has been altered by the presence of a heterologous nucleic acid including those transgenics initially so altered as well as those created by sexual crosses or asexual propagation from the initial transgenic.

A transgenic "event" is produced by transformation of plant cells with a heterologous DNA construct, including a nucleic acid expression cassette that comprises a gene of interest, the regeneration of a population of plants resulting from the insertion of the transferred gene into the genome of the plant and selection of a plant characterized by insertion into a particular genome location. An event is characterized phenotypically by the expression of the inserted gene. At the genetic level, an event is part of the genetic makeup of a plant. The term "event" also refers to progeny produced by a sexual cross between the transformant and another plant wherein the progeny include the heterologous DNA.

Transformation protocols as well as protocols for introducing nucleotide sequences into plants may vary depending on the type of plant or plant cell, i.e., monocot or dicot, targeted for transformation. Suitable methods of introducing nucleotide sequences into plant cells and subsequent insertion into the plant genome include microinjection (Crossway et al. (1986) Biotechniques 4:320-334), electroporation (Riggs et al. (1986) Proc. Natl. Acad. Sci. USA 83:5602-5606, Agrobacterium-mediated transformation (Townsend et al., U.S. Pat. No. 5,563,055; Zhao et al., U.S. Pat. No. 5,981,840), direct gene transfer (Paszkowski et al. (1984) EMBO J. 3:2717-2722), and ballistic particle acceleration (see, for example, Sanford et al., U.S. Pat. No. 4,945,050; Tomes et al., U.S. Pat. No. 5,879,918; Tomes et al., U.S. Pat. No. 5,886,244; Bidney et al., U.S. Pat. No. 5,932,782; Tomes et al. (1995) "Direct DNA Transfer into Intact Plant Cells via Microprojectile Bombardment," in Plant Cell, Tissue, and Organ Culture: Fundamental Methods, ed. Gamborg and Phillips (Springer-Verlag, Berlin) (maize); McCabe et al. (1988) Biotechnology 6:923-926); and Lec1 transformation (WO 00/28058). Also see Weissinger et al. (1988) Ann. Rev. Genet. 22:421-477; Sanford et al. (1987) Particulate Science and Technology 5:27-37 (onion); Christou et al. (1988) Plant Physiol. 87:671-674 (soybean); McCabe et al. (1988) Bio/Technology 6:923-926 (soybean); Finer and McMullen (1991) In Vitro Cell Dev. Biol. 27P: 175-182 (soybean); Singh et al. (1998) Theor. Appl. Genet. 96:319-324 (soybean); Datta et al. (1990) Biotechnology 8:736-740 (rice); Klein et al. (1988) Proc. Natl. Acad. Sci. USA 85:4305-4309 (maize); Klein et al. (1988) Biotechnology 6:559-563 (maize); Tomes, U.S. Pat. No. 5,240,855; Buising et al., U.S. Pat. Nos. 5,322,783 and 5,324,646; Klein et al. (1988) Plant Physiol. 91:440-444 (maize); Fromm et al. (1990) Biotechnology 8:833-839 (maize); Hooykaas-Van Slogteren et al. (1984) Nature (London) 311:763-764; Bowen et al., U.S. Pat. No. 5,736,369 (cereals); Bytebier et al. (1987) Proc. Natl. Acad. Sci. USA 84:5345-5349 (Liliaceae); De Wet et al. (1985) in The Experimental Manipulation of Ovule Tissues, ed. Chapman et al. (Longman, New York), pp. 197-209 (pollen); Kaeppler et al. (1990) Plant Cell Reports 9:415-418 and Kaeppler et al. (1992) Theor. Appl. Genet. 84:560-566 (whisker-mediated transformation); D'Halluin et al. (1992) Plant Cell 4:1495-1505 (electroporation); Li et al. (1993) Plant Cell Reports 12:250-255; Christou and Ford (1995) Annals of Botany 75:407-413 (rice); Osjoda et al. (1996) Nature Biotechnology 14:745-750 (maize via Agrobacterium tumefaciens); and US Patent Application Publication Number 2017/0121722 (rapid plant transformation) all of which are herein incorporated by reference in their entireties.

Nanocarrier-mediated gene delivery was first developed in mammalian systems but are rapidly gaining attention for delivery of nucleic acids into plants cells. Feasibility in plants was first demonstrated using mesoporous silica nanoparticles (~200 nm diameter) coupled to gold particles for biolistic delivery (Torney et al. (2007) Nat Nanotechnol 2: 295-300). Developments in plant transformation also include delivery of DNA using polyethyleneimine-coated $Fe_3O_4$ magnetic nanoparticles (MNP) as carriers and applying a magnetic force to direct the MNP-DNA complexes into cotton pollen grains (Zhao et al. (2017) Nat Plants 3:956-964). As opposed to the above two methods that require an external force to transfer the particles into the plant cell, carbon nanotubes (CNTs) have been shown to diffuse into plant cells and can be chemically modified for DNA delivery into either the nucleus (Demirer et al. (2019) Nat Nanotechnol doi.org/10.1038/s41565-019-0382-5) or the chloroplast (Kwak et al. (2019) Nat Nanotechnol https://doi.org/10.1038/s41565-019-0375-4). In addition, CNTs have been used to successfully deliver siRNA into plant cells (Demirer et al. (2019) SSRN https://doi.org/10.2139/ssrn.3352632; Zhang (2019) Proc Natl Acad Sci 116, 7543-7548). These recent studies also show that associating nucleic acids with nanotubules for delivery into plant cells appears to protect DNA and RNA cargoes from degradation, potentially extending cargo lifetime.

Some of the methods provided herein rely upon the use of bacteria-mediated and/or biolistic-mediated gene transfer to produce regenerable plant cells having an incorporated nucleotide sequence of interest. Bacterial strains useful in the methods of the present disclosure include, but are not limited to, a disarmed *Agrobacterium* including, but are not limited to, AGL-1, EHA105, GV3101, LBA4404, LBA4404 THY-, and LBA4404 THY-Tn904-, an *Ochrobactrum* bacteria (see U.S. Pat. Pub. No. US20180216123 A1) or a Rhizobiaceae bacteria (see U.S. Pat. No. 9,365,859).

*Ochrobactrum* bacterial strains useful in the present methods include, but are not limited to, those listed in Table 2.

TABLE 2

| |
|---|
| *Ochrobactrum haywardense* H1 NRRL Deposit B-67078 |
| *Ochrobactrum cytisi* |
| *Ochrobactrum daejeonense* |
| *Ochrobactrum oryzae* |
| *Ochrobactrum tritici* LBNL124-A-10 |
| HTG3-C-07 |
| *Ochrobactrum pecoris* |
| *Ochrobactrum ciceri* |
| *Ochrobactrum gallinifaecis* |
| *Ochrobactrum grignonense* |
| *Ochrobactrum guangzhouense* |
| *Ochrobactrum haematophilum* |
| *Ochrobactrum intermedium* |
| *Ochrobactrum lupini* |
| *Ochrobactrum pituitosum* |
| *Ochrobactrum pseudintermedium* |
| *Ochrobactrum pseudogrignonense* |
| *Ochrobactrum rhizosphaerae* |
| *Ochrobactrum thiophenivorans* |
| *Ochrobactrum tritici* |

Rhizobiaceae bacterial strains useful in the present methods include, but are not limited to, those listed in Table 3.

TABLE 3

| |
|---|
| *Rhizobium lusitanum* |
| *Rhizobium rhizogenes* |
| *Agrobacterium rubi* |
| *Rhizobium multihospitium* |
| *Rhizobium tropici* |
| *Rhizobium miluonense* |
| *Rhizobium leguminosarum* |
| *Rhizobium leguminosarum* bv. *trifolii* |
| *Rhizobium leguminosarum* bv. *phaseoli* |
| *Rhizobium leguminosarum*. bv. *viciae* |
| *Rhizobium leguminosarum* Madison |
| *Rhizobium leguminosarum* USDA2370 |
| *Rhizobium leguminosarum* USDA2408 |
| *Rhizobium leguminosarum* USDA2668 |
| *Rhizobium leguminosarum* 2370G |
| *Rhizobium leguminosarum* 2370LBA |
| *Rhizobium leguminosarum* 2048G |
| *Rhizobium leguminosarum* 2048LBA |
| *Rhizobium leguminosarum* bv. *phaseoli* 2668G |
| *Rhizobium leguminosarum* bv. *phaseoli* 2668LBA |
| *Rhizobium leguminosarum* RL542C |
| *Rhizobium etli* USDA 9032 |
| *Rhizobium etli* bv. *phaseoli* |
| *Rhizobium endophyticum* |
| *Rhizobium tibeticum* |
| *Rhizobium etli* |
| *Rhizobium pisi* |
| *Rhizobium phaseoli* |
| *Rhizobium fabae* |
| *Rhizobium hainanense* |
| *Arthrobacter viscosus* |
| *Rhizobium alamii* |

TABLE 3-continued

| |
|---|
| *Rhizobium mesosinicum* |
| *Rhizobium sullae* |
| *Rhizobium indigoferae* |
| *Rhizobium gallicum* |
| *Rhizobium yanglingense* |
| *Rhizobium mongolense* |
| *Rhizobium oryzae* |
| *Rhizobium loessense* |
| *Rhizobium tubonense* |
| *Rhizobium cellulosilyticum* |
| *Rhizobium soli* |
| *Neorhizobium galegae* |
| *Neorhizobium vignae* |
| *Neorhizobium huautlense* |
| *Neorhizobium alkalisoli* |
| *Aureimonas altamirensis* |
| *Aureimonas frigidaquae* |
| *Aureimonas ureilytica*. *Aurantimonas coralicida* |
| *Fulvimarina pelagi* |
| *Martelella mediterranea* |
| *Allorhizobium undicola* |
| *Allorhizobium vitis* |
| *Allorhizobium borbor* |
| *Beijerinckia fluminensis* |
| *Agrobacterium larrymoorei* |
| *Agrobacterium radiobacter* |
| *Rhizobium selenitireducens* corrig. *Rhizobium rosettiformans* |
| *Rhizobium daejeonense* |
| *Rhizobium aggregatum* |
| *Pararhizobium capsulatum* |
| *Pararhizobium giardinii* |
| *Ensifer mexicanus* |
| *Ensifer terangae* |
| *Ensifer saheli* |
| *Ensifer kostiensis* |
| *Ensifer kummerowiae* |
| *Ensifer fredii* |
| *Sinorhizobium americanum* |
| *Ensifer arboris* |
| *Ensifer garamanticus* |
| *Ensifer meliloti* |
| *Ensifer numidicus* |
| *Ensifer adhaerens* |
| *Sinorhizobium* sp. |
| *Sinorhizobium meliloti* SD630 |
| *Sinorhizobium meliloti* USDA1002 |
| *Sinorhizobium fredii* USDA205 |
| *Sinorhizobium fredii* SF542G |
| *Sinorhizobium fredii* SF4404 |
| *Sinorhizobium fredii* SM542C. |

Polynucleotides may be introduced into plants by contacting plants with a virus or viral nucleic acids. Generally, such methods involve incorporating a nucleotide construct of the present disclosure within a viral DNA or RNA molecule. Methods for introducing polynucleotides into plants and expressing a protein encoded therein, involving viral DNA or RNA molecules, are known in the art. See, for example, U.S. Pat. Nos. 5,889,191, 5,889,190, 5,866,785, 5,589,367, 5,316,931 and Porta, et al., (1996) Molecular Biotechnology 5:209-221, herein incorporated by reference in their entirety.

The methods of the present disclosure involve introducing a polypeptide or polynucleotide into a plant. As used herein, "introducing" means presenting to the plant the polynucleotide or polypeptide in such a manner that the sequence gains access to the interior of a cell of the plant. The methods of the present disclosure do not depend on a particular method for introducing a sequence into a plant, only that the polynucleotide or polypeptides gains access to the interior of at least one cell of the plant. Methods for introducing polynucleotide or polypeptides into plants are known in the art including, but not limited to, stable transformation methods, transient transformation methods and virus-mediated methods.

A "stable transformation" is a transformation in which a nucleotide construct or an expression cassette introduced into a plant integrates into the genome of the plant and is capable of being inherited by the progeny thereof "Transient transformation" means that a polynucleotide or an expression cassette is introduced into the plant and does not integrate into the genome of the plant or that a polypeptide is introduced into a plant.

Reporter genes or selectable marker genes may also be included in the expression cassettes discloses herein and used in the methods of the present disclosure. Examples of suitable reporter genes known in the art can be found in, for example, Jefferson, et al., (1991) in Plant Molecular Biology Manual, ed. Gelvin, et al., (Kluwer Academic Publishers), pp. 1-33; DeWet, et al., (1987) Mol. Cell. Biol. 7:725-737; Goff, et al., (1990) EMBO J. 9:2517-2522; Kain, et al., (1995) Bio Techniques 19:650-655 and Chiu, et al., (1996) Current Biology 6:325-330, herein incorporated by reference in their entirety.

A selectable marker comprises a DNA segment that allows one to identify or select for or against a molecule or a cell that contains it, often under particular conditions. These markers can encode an activity, such as, but not limited to, production of RNA, peptide, or protein, or can provide a binding site for RNA, peptides, proteins, inorganic and organic compounds or compositions and the like. Examples of selectable markers include, but are not limited to, DNA segments that comprise restriction enzyme sites; DNA segments that encode products which provide resistance against otherwise toxic compounds (e.g., antibiotics, such as, spectinomycin, ampicillin, kanamycin, tetracycline, Basta, neomycin phosphotransferase II (NEO) and hygromycin phosphotransferase (HPT)); DNA segments that encode products which are otherwise lacking in the recipient cell (e.g., tRNA genes, auxotrophic markers); DNA segments that encode products which can be readily identified (e.g., phenotypic markers such as β-galactosidase, GUS; fluorescent proteins such as green fluorescent protein (GFP), cyan (CFP), yellow (YFP), red (RFP), and cell surface proteins); the generation of new primer sites for PCR (e.g., the juxtaposition of two DNA sequence not previously juxtaposed), the inclusion of DNA sequences not acted upon or acted upon by a restriction endonuclease or other DNA modifying enzyme, chemical, etc.; and, the inclusion of a DNA sequences required for a specific modification (e.g., methylation) that allows its identification.

Selectable marker genes for selection of transformed cells or tissues can include genes that confer antibiotic resistance or resistance to herbicides. Examples of suitable selectable marker genes include, but are not limited to, genes encoding resistance to chloramphenicol (Herrera Estrella, et al., (1983) EMBO J. 2:987-992); methotrexate (Herrera Estrella, et al., (1983) Nature 303:209-213; Meijer, et al., (1991) Plant Mol. Biol. 16:807-820); hygromycin (Waldron, et al., (1985) Plant Mol. Biol. 5:103-108 and Zhijian, et al., (1995) Plant Science 108:219-227); streptomycin (Jones, et al., (1987) Mol. Gen. Genet. 210:86-91); spectinomycin (Bretagne-Sagnard, et al., (1996) Transgenic Res. 5:131-137); bleomycin (Hille, et al., (1990) Plant Mol. Biol. 7:171-176); sulfonamide (Guerineau, et al., (1990) Plant Mol. Biol. 15:127-36); bromoxynil (Stalker, et al., (1988) Science 242:419-423); glyphosate (Shaw, et al., (1986) Science 233:478-481 and U.S. patent application Ser. Nos. 10/004,357 and 10/427,692); phosphinothricin (DeBlock, et al., (1987) EMBO J. 6:2513-2518), herein incorporated by reference in their entirety.

Selectable markers that confer resistance to herbicidal compounds include genes encoding resistance and/or tolerance to herbicidal compounds, such as glyphosate, sulfonylureas, glufosinate ammonium, bromoxynil, imidazolinones, and 2,4-dichlorophenoxyacetate (2,4-D). See generally, Yarranton (1992) Curr. Opin. Biotech. 3:506-511; Christopherson et al. (1992) Proc. Natl. Acad. Sci. USA 89:6314-6318; Yao et al. (1992) Cell 71:63-72; Reznikoff (1992) Mol. Microbiol. 6:2419-2422; Barkley et al. (1980) in The Operon, pp. 177-220; Hu et al. (1987) Cell 48:555-566; Brown et al. (1987) Cell 49:603-612; Figge et al. (1988) Cell 52:713-722; Deuschle et al. (1989) Proc. Natl. Acad. Sci. USA 86:5400-5404; Fuerst et al. (1989) Proc. Natl. Acad. Sci. USA 86:2549-2553; Deuschle et al. (1990) Science 248:480-483; Gossen (1993) Ph.D. Thesis, University of Heidelberg; Reines et al. (1993) Proc. Natl. Acad. Sci. USA 90:1917-1921; Labow et al. (1990) Mol. Cell. Biol. 10:3343-3356; Zambretti et al. (1992) Proc. Natl. Acad. Sci. USA 89:3952-3956; Bairn et al. (1991) Proc. Natl. Acad. Sci. USA 88:5072-5076; Wyborski et al. (1991) Nucleic Acids Res. 19:4647-4653; Hillen and Wissman (1989) Topics Mol. Struc. Biol. 10:143-162; Degenkolb et al. (1991) Antimicrob. Agents Chemother. 35:1591-1595; Kleinschmidt et al. (1988) Biochemistry 27:1094-1104; Bonin (1993) Ph.D. Thesis, University of Heidelberg; Gossen et al. (1992) Proc. Natl. Acad. Sci. USA 89:5547-5551; Oliva et al. (1992) Antimicrob. Agents Chemother. 36:913-919; Hlavka et al. (1985) Handbook of Experimental Pharmacology, Vol. 78 (Springer-Verlag, Berlin); Gill et al. (1988) Nature 334:721-724. Such disclosures are herein incorporated by reference.

Certain selectable markers useful in the present methods include, but are not limited to, the maize HRA gene (Lee et al., 1988, EMBO J 7:1241-1248) which confers resistance to sulfonylureas and imidazolinones, the GAT gene which confers resistance to glyphosate (Castle et al., 2004, Science 304:1151-1154), genes that confer resistance to spectinomycin such as the aadA gene (Svab et al., 1990, Plant Mol Biol. 14:197-205) and the bar gene that confers resistance to glufosinate ammonium (White et al., 1990, Nucl. Acids Res. 25:1062), and PAT (or moPAT for corn, see Rasco-Gaunt et al., 2003, Plant Cell Rep.21:569-76) and the PMI gene that permits growth on mannose-containing medium (Negrotto et al., 2000, Plant Cell Rep. 22:684-690) are very useful for rapid selection during the brief elapsed time encompassed by somatic embryogenesis and embryo maturation of the method. However, depending on the selectable marker used and the crop, inbred or variety being transformed, the percentage of wild-type escapes can vary. In maize and sorghum, the HRA gene is efficacious in reducing the frequency of wild-type escapes.

Other genes that could have utility in the recovery of transgenic events would include, but are not limited to, examples such as GUS (beta-glucuronidase; Jefferson, (1987) Plant Mol. Biol. Rep. 5:387), GFP (green fluorescence protein; Chalfie, et al., (1994) Science 263:802), luciferase (Riggs, et al., (1987) Nucleic Acids Res. 15(19): 8115 and Luehrsen, et al., (1992) Methods Enzymol. 216: 397-414), various fluorescent proteins with a spectrum of alternative emission optima spanning Far-Red, Red, Orange, Yellow, Green Cyan and Blue (Shaner et al., 2005, Nature Methods 2:905-909) and the maize genes encoding for anthocyanin production (Ludwig, et al., (1990) Science 247:449), herein incorporated by reference in their entireties.

The above list of selectable markers is not meant to be limiting. Any selectable marker can be used in the methods of the present disclosure.

In an aspect, the methods of the present disclosure provide transformation methods that allow positive growth selection. One skilled in the art can appreciate that conventional plant transformation methods have relied predominantly on negative selection schemes as described above, in which an antibiotic or herbicide (a negative selective agent) is used to inhibit or kill non-transformed cells or tissues, and the transgenic cells or tissues continue to grow due to expression of a resistance gene. In contrast, the methods of the present disclosure can be used with no application of a negative selective agent. Thus, although wild-type cells can grow unhindered, by comparison cells impacted by the controlled expression of a morphogenic gene can be readily identified due to their accelerated growth rate relative to the surrounding wild-type tissue. In addition to simply observing faster growth, the methods of the present disclosure provide transgenic cells that exhibit more rapid morphogenesis relative to non-transformed cells. Accordingly, such differential growth and morphogenic development can be used to easily distinguish transgenic plant structures from the surrounding non-transformed tissue, a process which is termed herein as "positive growth selection."

The present disclosure provides methods for producing transgenic plants with increased efficiency and speed and providing significantly higher transformation frequencies and significantly more quality events (events containing one copy of a trait gene expression cassette with no vector (plasmid) backbone) in multiple inbred lines using a variety of starting tissue types, including transformed inbreds representing a range of genetic diversities and having significant commercial utility. The disclosed methods can further comprise polynucleotides that provide for improved traits and characteristics.

As used herein, "trait" refers to a physiological, morphological, biochemical, or physical characteristic of a plant or particular plant material or cell. In some instances, this characteristic is visible to the human eye, such as seed or plant size, or can be measured by biochemical techniques, such as detecting the protein, starch, or oil content of seed or leaves, or by observation of a metabolic or physiological process, e.g. by measuring uptake of carbon dioxide, or by the observation of the expression level of a gene or genes, e.g., by employing Northern analysis, RT-PCR, microarray gene expression assays, or reporter gene expression systems, or by agricultural observations such as stress tolerance, yield, or pathogen tolerance.

Agronomically important traits such as oil, starch, and protein content can be genetically altered in addition to using traditional breeding methods. Modifications include increasing content of oleic acid, saturated and unsaturated oils, increasing levels of lysine and sulfur, providing essential amino acids, and also modification of starch. Hordothionin protein modifications are described in U.S. Pat. Nos. 5,703,049, 5,885,801, 5,885,802, and 5,990,389, herein incorporated by reference. Another example is lysine and/or sulfur rich seed protein encoded by the soybean 2S albumin described in U.S. Pat. No. 5,850,016, and the chymotrypsin inhibitor from barley, described in Williamson et al. (1987) Eur. J. Biochem. 165:99-106, the disclosures of which are herein incorporated by reference.

Derivatives of the coding sequences can be made by site-directed mutagenesis to increase the level of preselected amino acids in the encoded polypeptide. For example, methionine-rich plant proteins such as from sunflower seed (Lilley et al. (1989) Proceedings of the World Congress on Vegetable Protein Utilization in Human Foods and Animal Feedstuffs, ed. Applewhite (American Oil Chemists Society, Champaign, Ill.), pp. 497-502; herein incorporated by reference); corn (Pedersen et al. (1986) J. Biol. Chem. 261: 6279; Kirihara et al. (1988) Gene 71:359; both of which are herein incorporated by reference); and rice (Musumura et al. (1989) Plant Mol. Biol. 12:123, herein incorporated by reference) could be used. Other agronomically important genes encode latex, Floury 2, growth factors, seed storage factors, and transcription factors.

Many agronomic traits can affect "yield", including without limitation, plant height, pod number, pod position on the plant, number of internodes, incidence of pod shatter, grain size, efficiency of nodulation and nitrogen fixation, efficiency of nutrient assimilation, resistance to biotic and abiotic stress, carbon assimilation, plant architecture, resistance to lodging, percent seed germination, seedling vigor, and juvenile traits. Other traits that can affect yield include, efficiency of germination (including germination in stressed conditions), growth rate (including growth rate in stressed conditions), ear number, seed number per ear, seed size, composition of seed (starch, oil, protein) and characteristics of seed fill. Also of interest is the generation of transgenic plants that demonstrate desirable phenotypic properties that may or may not confer an increase in overall plant yield. Such properties include enhanced plant morphology, plant physiology or improved components of the mature seed harvested from the transgenic plant.

"Increased yield" of a transgenic plant of the present disclosure may be evidenced and measured in a number of ways, including test weight, seed number per plant, seed weight, seed number per unit area (i.e. seeds, or weight of seeds, per acre), bushels per acre, tons per acre, kilo per hectare. For example, maize yield may be measured as production of shelled corn kernels per unit of production area, e.g. in bushels per acre or metric tons per hectare, often reported on a moisture adjusted basis, e.g., at 15.5% moisture. Increased yield may result from improved utilization of key biochemical compounds, such as nitrogen, phosphorous and carbohydrate, or from improved tolerance to environmental stresses, such as cold, heat, drought, salt, and attack by pests or pathogens. Trait-enhancing recombinant DNA may also be used to provide transgenic plants having improved growth and development, and ultimately increased yield, as the result of modified expression of plant growth regulators or modification of cell cycle or photosynthesis pathways.

An "enhanced trait" as used in describing the aspects of the present disclosure includes improved or enhanced water use efficiency or drought tolerance, osmotic stress tolerance, high salinity stress tolerance, heat stress tolerance, enhanced cold tolerance, including cold germination tolerance, increased yield, improved seed quality, enhanced nitrogen use efficiency, early plant growth and development, late plant growth and development, enhanced seed protein, and enhanced seed oil production.

Any polynucleotide of interest or trait gene can be used in the methods of the present disclosure. Various changes in phenotype, imparted by a gene of interest or trait gene, include those for modifying the fatty acid composition in a plant, altering the amino acid content, starch content, or carbohydrate content of a plant, altering a plant's pathogen defense mechanism, altering kernel size, altering sucrose loading, and the like. The gene of interest or trait gene may also be involved in regulating the influx of nutrients, and in regulating expression of phytate genes particularly to lower phytate levels in the seed. These results can be achieved by providing expression of heterologous products or increased expression of endogenous products in plants. Alternatively, the results can be achieved by providing for a reduction of expression of one or more endogenous products, particularly enzymes or cofactors in the plant. These changes result in a change in phenotype of the transformed plant.

As used herein, "trait gene" means a gene of interest to be integrated into the plant genome to produce a fertile transgenic T0 plant. Selectable markers such as the Highly-Resistant Acetolactate Synthase (HRA) and visual makers such as fluorescent protein genes are used herein by way of example. A trait gene could be any gene (or combination of genes) that confer a value-added agronomic, physiological, biochemical, or physical phenotype.

Genes of interest/trait genes are reflective of the commercial markets and interests of those involved in the development of the crop. Crops and markets of interest change, and as developing nations open up world markets, new crops and technologies will emerge also. In addition, as the understanding of agronomic traits and characteristics such as yield and heterosis increase, the choice of genes and traits for transformation will change accordingly. General categories of nucleotide sequences or genes of interest or trait genes useful in the methods of the present disclosure include, for example, those genes involved in information, such as zinc fingers, those involved in communication, such as kinases, and those involved in housekeeping, such as heat shock proteins. More specific categories of transgenes, for example, include genes encoding important traits for agronomics, insect resistance, disease resistance, herbicide resistance, sterility, environmental stress resistance (altered tolerance to cold, salt, drought, etc.), grain characteristics, and commercial products.

Heterologous coding sequences, heterologous polynucleotides, and polynucleotides of interest expressed by a promoter sequence transformed by the methods disclosed herein may be used for varying the phenotype of a plant. Various changes in phenotype are of interest including modifying expression of a gene in a plant, altering a plant's pathogen or insect defense mechanism, increasing a plant's tolerance to herbicides, altering plant development to respond to environmental stress, modulating the plant's response to salt, temperature (hot and cold), drought and the like. These results can be achieved by the expression of a heterologous nucleotide sequence of interest comprising an appropriate gene product. In specific aspects, the heterologous nucleotide sequence of interest is an endogenous plant sequence whose expression level is increased in the plant or plant part. Results can be achieved by providing for altered expression of one or more endogenous gene products, particularly hormones, receptors, signaling molecules, enzymes, transporters or cofactors or by affecting nutrient uptake in the plant. These changes result in a change in phenotype of the transformed plant. Still other categories of transgenes include genes for inducing expression of exogenous products such as enzymes, cofactors, and hormones from plants and other eukaryotes as well as prokaryotic organisms.

It is recognized that any gene of interest, polynucleotide of interest, trait gene or multiple genes/polynucleotides/traits of interest can be operably linked to a promoter or promoters and expressed in a plant transformed by the methods disclosed herein, for example insect resistance trait genes which can be stacked with one or more additional input trait genes (e.g., herbicide resistance, fungal resistance, virus resistance, stress tolerance, disease resistance, male sterility, stalk strength, and the like) or output trait genes (e.g., increased yield, modified starches, improved oil profile, balanced amino acids, high lysine or methionine, increased digestibility, improved fiber quality, drought resistance, and the like).

A promoter can be operably linked to agronomically important trait genes for expression in plants transformed by the methods disclosed herein that affect quality of grain, such as levels (increasing content of oleic acid) and types of oils, saturated and unsaturated, quality and quantity of essential amino acids, increasing levels of lysine and sulfur, levels of cellulose, and starch and protein content. A promoter can be operably linked to trait genes providing hordothionin protein modifications for expression in plants transformed by the methods disclosed herein which are described in U.S. Pat. Nos. 5,990,389; 5,885,801; 5,885,802 and 5,703,049; herein incorporated by reference in their entirety. Another example of a trait gene to which a promoter can be operably linked to for expression in plants transformed by the methods disclosed herein is a lysine and/or sulfur rich seed protein encoded by the soybean 2S albumin described in U.S. Pat. No. 5,850,016, and the chymotrypsin inhibitor from barley, Williamson, et al., (1987) Eur. J. Biochem 165:99-106, the disclosures of which are herein incorporated by reference in their entirety.

A promoter can be operably linked to insect resistance trait genes that encode resistance to pests that have yield drag such as rootworm, cutworm, European corn borer and the like for expression in plants transformed by the methods disclosed herein. Such genes include, for example, *Bacillus thuringiensis* toxic protein genes, U.S. Pat. Nos. 5,366,892; 5,747,450; 5,736,514; 5,723,756; 5,593,881 and Geiser, et al., (1986) Gene 48:109, the disclosures of which are herein incorporated by reference in their entirety. Trait genes encoding disease resistance traits that can be operably linked to a promoter for expression in plants transformed by the methods disclosed herein include, for example, detoxification genes, such as those which detoxify fumonisin (U.S. Pat. No. 5,792,931); avirulence (avr) and disease resistance (R) genes (Jones, et al., (1994) Science 266:789; Martin, et al., (1993) Science 262:1432; and Mindrinos, et al., (1994) Cell 78:1089), herein incorporated by reference in their entirety.

Herbicide resistance trait genes that can be operably linked to a promoter for expression in plants transformed by the methods disclosed herein include genes coding for resistance to herbicides that act to inhibit the action of acetolactate synthase (ALS), in particular the sulfonylurea-type herbicides (e.g., the acetolactate synthase (ALS) gene containing mutations leading to such resistance, in particular the S4 and/or Hra mutations), genes coding for resistance to herbicides that act to inhibit action of glutamine synthase, such as phosphinothricin or basta (e.g., the bar gene), genes coding for resistance to glyphosate (e.g., the EPSPS gene and the GAT gene; see, for example, US Patent Application Publication Number 2004/0082770, WO 03/092360 and WO 05/012515, herein incorporated by reference in their entirety) or other such genes known in the art. The bar gene encodes resistance to the herbicide basta, the nptII gene encodes resistance to the antibiotics kanamycin and geneticin and the ALS-gene mutants encode resistance to the herbicide chlorsulfuron any and all of which can be operably linked to a promoter for expression in plants transformed by the methods disclosed herein.

Glyphosate resistance is imparted by mutant 5-enolpyruvl-3-phosphikimate synthase (EPSPS) and aroA genes which can be operably linked to a promoter for expression in plants transformed by the methods disclosed herein. See, for example, U.S. Pat. No. 4,940,835 to Shah, et al., which discloses the nucleotide sequence of a form of EPSPS which can confer glyphosate resistance. U.S. Pat. No. 5,627,061 to Barry, et al., also describes genes encoding EPSPS enzymes which can be operably linked to a promoter for expression in plants transformed by the methods disclosed herein. See also, U.S. Pat. Nos. 6,248,876 B1; 6,040,497; 5,804,425; 5,633,435; 5,145,783; 4,971,908; 5,312,910; 5,188,642; 4,940,835; 5,866,775; 6,225,114 B1; 6,130,366; 5,310,667; 4,535,060; 4,769,061; 5,633,448; 5,510,471; Re. 36,449; RE 37,287 E and 5,491,288 and international publications WO 97/04103; WO 97/04114; WO 00/66746; WO 01/66704; WO 00/66747 and WO 00/66748, which are incorporated herein by reference in their entirety. Glyphosate resistance is also imparted to plants that express a gene which can be operably linked to a promoter for expression in plants transformed by the methods disclosed herein that encodes a glyphosate oxidoreductase enzyme as described more fully in U.S. Pat. Nos. 5,776,760 and 5,463,175, which are incorporated herein by reference in their entirety. Glyphosate resistance can also be imparted to plants by the over expression of genes which can be operably linked to a promoter for expression in plants transformed by the methods disclosed herein encoding glyphosate N-acetyltransferase. See, for example, US Patent Application Publication Number 2004/0082770, WO 03/092360 and WO 05/012515, herein incorporated by reference in their entirety.

Sterility genes operably linked to a promoter for expression in plants transformed by the methods disclosed herein can also be encoded in a DNA construct and provide an alternative to physical detasseling. Examples of genes used in such ways include male tissue-preferred genes and genes with male sterility phenotypes such as QM, described in U.S. Pat. No. 5,583,210, herein incorporated by reference in its entirety. Other genes which can be operably linked to a promoter for expression in plants transformed by the methods disclosed herein include kinases and those encoding compounds toxic to either male or female gametophytic development.

Commercial traits can also be encoded by a gene or genes operably linked to a promoter for expression in plants transformed by the methods disclosed herein that could increase for example, starch for ethanol production, or provide expression of proteins. Another important commercial use of transformed plants is the production of polymers and bioplastics such as described in U.S. Pat. No. 5,602,321, herein incorporated by reference in its entirety. Genes such as β-Ketothiolase, PHBase (polyhydroxybutyrate synthase), and acetoacetyl-CoA reductase, which facilitate expression of polyhydroxyalkanoates (PHAs) can be operably linked to a promoter for expression in plants transformed by the methods disclosed herein (see, Schubert, et al., (1988) J. Bacteriol. 170:5837-5847, herein incorporated by reference in its entirety).

Examples of other applicable trait genes and their associated phenotype which can be operably linked to a promoter for expression in plants transformed by the methods disclosed herein include genes that encode viral coat proteins and/or RNAs, or other viral or plant genes that confer viral resistance; genes that confer fungal resistance; genes that promote yield improvement; and genes that provide for resistance to stress, such as cold, dehydration resulting from drought, heat and salinity, toxic metal or trace elements or the like.

Numerous trait genes are known in the art and can be used in the methods disclosed herein. By way of illustration, without intending to be limiting, trait genes that confer resistance to insects or diseases, trait genes that confer resistance to a herbicide, trait genes that confer or contribute to an altered grain characteristic, such as altered fatty acids, altered phosphorus content, altered carbohydrates or carbohydrate composition, altered antioxidant content or composition, or altered essential seed amino acids content or composition are examples of the types of trait genes which can be operably linked to a promoter for expression in plants transformed by the methods disclosed herein. Additional genes known in the art may be included in the expression cassettes useful in the methods disclosed herein. Non-limiting examples include genes that create a site for site specific DNA integration, genes that affect abiotic stress resistance (including but not limited to flowering, ear and seed development, enhancement of nitrogen utilization efficiency, altered nitrogen responsiveness, drought resistance or tolerance, cold resistance or tolerance, and salt resistance or tolerance) and increased yield under stress, or other genes and transcription factors that affect plant growth and agronomic traits such as yield, flowering, plant growth and/or plant structure.

As used herein, "antisense orientation" includes reference to a polynucleotide sequence that is operably linked to a promoter in an orientation where the antisense strand is transcribed. The antisense strand is sufficiently complementary to an endogenous transcription product such that translation of the endogenous transcription product is often inhibited. "Operably linked" refers to the association of two or more nucleic acid fragments on a single nucleic acid fragment so that the function of one is affected by the other. For example, a promoter is operably linked with a coding sequence when it is capable of affecting the expression of that coding sequence (i.e., that the coding sequence is under the transcriptional control of the promoter). Coding sequences can be operably linked to regulatory sequences in sense or antisense orientation.

A heterologous nucleotide sequence operably linked to a promoter and its related biologically active fragments or variants useful in the methods disclosed herein may be an antisense sequence for a targeted gene. The terminology "antisense DNA nucleotide sequence" is intended to mean a sequence that is in inverse orientation to the 5'-to-3' normal orientation of that nucleotide sequence. When delivered into a plant cell, expression of the antisense DNA sequence prevents normal expression of the DNA nucleotide sequence for the targeted gene. The antisense nucleotide sequence encodes an RNA transcript that is complementary to and capable of hybridizing to the endogenous messenger RNA (mRNA) produced by transcription of the DNA nucleotide sequence for the targeted gene. In this case, production of the native protein encoded by the targeted gene is inhibited to achieve a desired phenotypic response. Modifications of the antisense sequences may be made as long as the sequences hybridize to and interfere with expression of the corresponding mRNA. In this manner, antisense constructions having 70%, 80%, 85% sequence identity to the corresponding antisense sequences may be used. Furthermore, portions of the antisense nucleotides may be used to disrupt the expression of the target gene. Generally, sequences of at least 50 nucleotides, 100 nucleotides, 200 nucleotides or greater may be used. Thus, a promoter may be operably linked to antisense DNA sequences to reduce or inhibit expression of a native protein in the plant when transformed by the methods disclosed herein.

"RNAi" refers to a series of related techniques to reduce the expression of genes (see, for example, U.S. Pat. No. 6,506,559, herein incorporated by reference in its entirety). Older techniques referred to by other names are now thought to rely on the same mechanism but are given different names in the literature. These include "antisense inhibition," the production of antisense RNA transcripts capable of suppressing the expression of the target protein and "co-suppression" or "sense-suppression," which refer to the production of sense RNA transcripts capable of suppressing the expression of identical or substantially similar foreign or endogenous genes (U.S. Pat. No. 5,231,020, incorporated herein by reference in its entirety). Such techniques rely on the use of constructs resulting in the accumulation of double stranded RNA with one strand complementary to the target gene to be silenced.

As used herein, the terms "promoter" or "transcriptional initiation region" mean a regulatory region of DNA usually comprising a TATA box or a DNA sequence capable of directing RNA polymerase II to initiate RNA synthesis at the appropriate transcription initiation site for a particular coding sequence. A promoter may additionally comprise other recognition sequences generally positioned upstream or 5' to the TATA box or the DNA sequence capable of directing RNA polymerase II to initiate RNA synthesis, referred to as upstream promoter elements, which influence the transcription initiation rate.

The transcriptional initiation region, the promoter, may be native or homologous or foreign or heterologous to the host, or could be the natural sequence or a synthetic sequence. By foreign is intended that the transcriptional initiation region is not found in the wild-type host into which the transcriptional initiation region is introduced. Either a native or heterologous promoter may be used with respect to the coding sequence of interest.

The transcriptional (expression) cassette will include in the 5'-3' direction of transcription, a transcriptional and translational initiation region, a DNA sequence of interest/trait gene, and a transcriptional and translational termination region functional in plants. The termination region may be native with the transcriptional initiation region, may be native with the DNA sequence of interest, or may be derived from another source. Convenient termination regions are available from the potato proteinase inhibitor (PinII) gene or sequences from Ti-plasmid of *A. tumefaciens*, such as the nopaline synthase, octopine synthase and opaline synthase termination regions. See also, Guerineau et al., (1991) Mol. Gen. Genet. 262: 141-144; Proudfoot (1991) Cell 64: 671-674; Sanfacon et al. (1991) Genes Dev. 5: 141-149; Mogen et al. (1990) Plant Cell 2: 1261-1272; Munroe et al. (1990) Gene 91: 151-158; Ballas et al. 1989) Nucleic Acids Res. 17: 7891-7903; Joshi et al. (1987) Nucleic Acid Res. 15: 9627-9639.

The expression cassettes may additionally contain 5' leader sequences in the expression cassette construct. Such leader sequences can act to enhance translation. Translation leaders are known in the art and include: picornavirus leaders, for example, EMCV leader (Encephalomyocarditis 5'noncoding region) (Elroy-Stein, O., Fuerst, T. R., and Moss, B. (1989) PNAS USA, 86: 6126-6130); potyvirus leaders, for example, TEV leader (Tobacco Etch Virus) (Allison et al. (1986); MDMV leader (Maize Dwarf Mosaic Virus); Virology, 154: 9-20), and human immunoglobulin heavy-chain binding protein (BiP), (Macejak, D. G., and P. Sarnow (1991) Nature, 353: 90-94; untranslated leader from the coat protein MARNA of alfalfa mosaic virus (AMV RNA 4), (Jobling, S. A., and Gehrke, L., (1987) Nature, 325: 622-625; tobacco mosaic virus leader (TMV), (Gallie et al. (1989) Molecular Biology of RNA, pages 237-256, Gallie et al. (1987) Nucl. Acids Res. 15: 3257-3273; maize chlorotic mottle virus leader (MCMV) (Lornmel, S. A. et al. (1991) Virology, 81: 382-385). See also, Della-Cioppa et al. (1987) Plant Physiology, 84: 965-968; and endogenous maize 5' untranslated sequences. Other methods known to enhance translation and to enhance mRNA stability can also be utilized, for example, introns, such as the maize Ubiquitin intron (Christensen and Quail, (1996) Transgenic Res. 5:213-218; Christensen, et al., (1992) Plant Molecular Biology 18:675-689) or the maize AdhI intron (Kyozuka, et al., (1991) Mol. Gen. Genet. 228:40-48; Kyozuka, et al., (1990) Maydica 35:353-357) and the like, herein incorporated by reference in their entirety.

The expression cassettes may contain one or more than one gene or nucleic acid sequence to be transferred and expressed in the transformed plant. Thus, each nucleic acid sequence will be operably linked to 5' and 3' regulatory sequences. Alternatively, multiple expression cassettes may be provided.

In preparing expression cassettes useful in the methods of the present disclosure, the various DNA fragments may be manipulated, to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites or the like. For this purpose, in vitro mutagenesis, primer repair, restriction, annealing, resubstitutions, for example, transitions and transversions, may be involved.

The morphogenic genes and/or trait genes/polynucleotides of interest introduced into an explant by the disclosed methods can be operably linked to a suitable promoter. A "plant promoter" is a promoter capable of initiating transcription in plant cells whether or not its origin is a plant cell. Exemplary plant promoters include, but are not limited to, those that are obtained from plants, plant viruses, and bacteria which comprise genes expressed in plant cells such as from *Agrobacterium* or *Rhizobium*. Examples of promoters under developmental control include promoters that preferentially initiate transcription in certain tissues, such as leaves, roots, or seeds. Such promoters are referred to as "tissue preferred". Promoters which initiate transcription only in certain tissues are referred to as "tissue specific". A "cell type" specific promoter primarily drives expression in certain cell types in one or more organs, for example, vascular cells in roots or leaves. Tissue specific, tissue preferred, cell type specific, and inducible promoters constitute the class of "non-constitutive" promoters.

An "inducible" or "repressible" promoter can be a promoter which is under either environmental or exogenous control. Examples of environmental conditions that may affect transcription by inducible promoters include anaerobic conditions, or certain chemicals, or the presence of light.

Alternatively, exogenous control of an inducible or repressible promoter can be affected by providing a suitable chemical or other agent that via interaction with target polypeptides result in induction or repression of the promoter. Inducible promoters include heat-inducible promoters, estradiol-responsive promoters, chemical inducible promoters, and the like. Pathogen inducible promoters include those from pathogenesis-related proteins (PR proteins), which are induced following infection by a pathogen; e. g., PR proteins, SAR proteins, beta-1,3-glucanase, chitinase, etc. See, for example, Redolfi et al. (1983) Neth. J. Plant Pathol. 89: 245-254; Uknes et al. (1992) The Plant Cell 4: 645-656; and Van Loon (1985) Plant Mol. Virol. 4: 111-116. Inducible promoters useful in the present methods include GLB1, OLE, LTP2, HSP17.7, HSP26, HSP18 A, and XVE promoters.

A chemically-inducible promoter can be repressed by the tetracycline repressor (TETR), the ethametsulfuron repressor (ESR), or the chlorsulfuron repressor (CSR), and de-repression occurs upon addition of tetracycline-related or sulfonylurea ligands. The repressor can be TETR and the tetracycline-related ligand is doxycycline or anhydrotetracycline. (Gatz, C., Frohberg, C. and Wendenburg, R. (1992) Stringent repression and homogeneous de-repression by tetracycline of a modified CaMV 35S promoter in intact transgenic tobacco plants, Plant J. 2, 397-404). Alternatively, the repressor can be ESR and the sulfonylurea ligand is ethametsulfuron, chlorsulfuron, metsulfuron-methyl, sulfometuron methyl, chlorimuron ethyl, nicosulfuron, primisulfuron, tribenuron, sulfosulfuron, trifloxysulfuron, foramsulfuron, iodosulfuron, prosulfuron, thifensulfuron, rimsulfuron, mesosulfuron, or halosulfuron (US20110287936 incorporated herein by reference in its entirety). If the repressor is CSR, the CSR ligand is chlorsulfuron. See, U.S. Pat. No. 8,580,556 incorporated herein by reference in its entirety.

A "constitutive" promoter is a promoter which is active under most conditions. Promoters useful in the present disclosure include those disclosed in WO2017/112006 and those disclosed in U.S. Provisional Application 62/562,663. Constitutive promoters for use in expression of genes in plants are known in the art. Such promoters include but are not limited to 35S promoter of cauliflower mosaic virus (Depicker et al. (1982) Mol. Appl. Genet. 1: 561-573; Odell et al. (1985) Nature 313: 810-812), ubiquitin promoter (Christensen et al. (1992) Plant Mol. Biol. 18: 675-689), promoters from genes such as ribulose bisphosphate carboxylase (De Almeida et al. (1989) Mol. Gen. Genet. 218: 78-98), actin (McElroy et al. (1990) Plant J. 2: 163-171), histone, DnaJ (Baszczynski et al. (1997) Maydica 42: 189-201), and the like. In various aspects, constitutive promoters useful in the methods of the present disclosure include UBI, LLDAV, EVCV, DMMV, BSV (AY) PRO, CYMV PRO FL, UBIZM PRO, SI-UB3 PRO, SB-UBI PRO (ALT1), USB1ZM PRO, ZM-GOS2 PRO, ZM-H1B PRO (1.2 KB), IN2-2, NOS, the −135 version of 35S, and ZM-ADF PRO (ALT2) promoters.

Promoters useful in the present disclosure, listed in Table 4 below, include those disclosed in U.S. Pat. Pub. No. US20170121722, U.S. Pat. Pub. No. US20180371480 and U.S. Pat. No. 8,710,206, herein incorporated by reference in their entirety.

TABLE 4

| Name | Description |
| --- | --- |
| ZM-PLTP | Z. mays PLTP promoter |
| SB-PLTP1 | Sorghum bicolor PLTP 1 promoter |
| ZM-FBP1 | Z. mays promoter for Fructose-1,6-bisphosphatase |
| ZM-RFP | Z. mays promoter for NAD(P)-binding Rossmann-Fold Protein |
| ZM-APMP | Z. mays promoter for adipocyte plasma membrane-associated protein-like protein |
| ZM-RfeSP | Z. mays promoter for Rieske [2Fe—2S] iron-sulphur domain protein |
| ZM-CRR6 | Z. mays promoter for Chlororespiratory reduction 6 gene |
| ZM-GLYK | Z. mays promoter for D-glycerate 3-kinase, chloroplastic-like protein gene |
| ZM-CAB7 | Z. mays promoter for Chlorophyll a-b binding protein 7, chloroplastic-like protein |
| ZM-UBR | Z. mays promoter for Ultraviolet-B-repressible protein gene |
| ZM-HBP | Z. mays promoter for Soul heme-binding family protein |
| ZM-PSAN | Z. mays promoter for Photosystem I reaction center subunit psi-N |
| ZM-SDR | Z. mays promoter for Short-chain dehydrogenase/reductase |
| AXIG1 | AXIG1 promoter |
| DR5 | DR5 promoter |
| ZM-PLTP1 | Z. mays PLTP1 promoter |
| ZM-PLTP2 | Z. mays PLTP2 promoter |
| SB-PLTP2 | Sorghum bicolor PLTP2 promoter |
| SB-PLTP3 | Sorghum bicolor PLTP3 promoter |
| SI-PLTP1 | Setaria italica PLTP promoter |
| OS-PLTP1 | Oryza sativa PLTP promoter e |
| OS-PLTP2 | Oryza sativa PLTP2 promoter |
| ZM-LGL PRO | Z. mays promoter for the lactoylglutathione lyase gene |
| ZM-LEA14-A PRO | Z. mays promoter for gene encoding late embryogenic abundant protein Lea-14-A |
| ZM-LEA34-D PRO | Z. mays promoter for gene encoding late embryogenic abundant protein Lea34-D |
| ZM-SDR PRO (long) | Z. mays promoter for the short-chain dehydrogenase/reductase (long) |
| OS-SDR PRO | O. sativa promoter for the short-chain dehydrogenase/reductase |
| SB-SDR PRO | S. bicolor promoter for the short-chain dehydrogenase/reductase |
| GM-EF1A PRO | Glycine max EF1A promoter |

Additional promoters useful in the methods of the present disclosure are listed in Table 5 below.

TABLE 5

| SEQ ID NO: | Promoter Name | Description |
|---|---|---|
| 35 | GM-HBSTART3 | *Glycine max* HBSTART3 (Homeodomain StAR-related lipid transfer3) promoter sequence |
| 36 | GM-HBSTART3 (TRUNCATED) | *Glycine max* HBSTART3 (Homeodomain StAR-related lipid transfer3) promoter sequence (TRUNCATED) |
| 37 | AT-ML1 | *Arabidopsis thaliana* ML1 (MERISTEM LAYER1) promoter sequence |
| 38 | GM-ML1-Like | *Glycine max* ML1-Like (MERISTEM LAYER1-Like) promoter sequence |
| 39 | GM-ML1-Like (TRUNCATED) | *Glycine max* ML1-Like (MERISTEM LAYER1-Like) promoter sequence (TRUNCATED) |
| 40 | ZM-HBSTART3 | *Zea mays* HBSTART3 (Homeodomain StAR-related lipid transfer3) promoter sequence |
| 41 | OS-HBSTART3 | *Oryza sativa* HBSTART3 (Homeodomain StAR-related lipid transfer3) promoter sequence |
| 42 | AT-PDF1 | *Arabidopsis thaliana* PDF1 (PROTODERMAL FACTOR1) promoter sequence |
| 43 | GM-PDF1 | *Glycine max* PDF1 (PROTODERMAL FACTOR1) promoter sequence |
| 44 | GM-PDF1 (TRUNCATED) | *Glycine max* PDF1 (PROTODERMAL FACTOR1) promoter sequence (TRUNCATED) |
| 45 | SB-PDF1 | *Sorghum bicolor* PDF1 (PROTODERMAL FACTOR1) promoter sequence |
| 46 | OS-PDF1 | *Oryza sativa* PDF1 (PROTODERMAL FACTOR1) promoter sequence |
| 47 | OS-PDF1 (TRUNCATED) | *Oryza sativa* PDF1 (PROTODERMAL FACTOR1) promoter sequence (TRUNCATED) |
| 48 | PT-PDF 1 | *Populus trichocarpa* PDF1 (PROTODERMAL FACTOR1) promoter sequence |
| 49 | PT-PDF 1 (TRUNCATED) | *Populus trichocarpa* PDF1 (PROTODERMAL FACTOR1) promoter sequence (TRUNCATED) |
| 50 | SI-PDF1 | *Setaria italica* PDF1 (PROTODERMAL FACTOR1) promoter sequence |
| 51 | SI-PDF1 (TRUNCATED) | *Setaria italica* PDF1 (PROTODERMAL FACTOR1) promoter sequence (TRUNCATED) |
| 52 | AT-PDF2 | *Arabidopsis thaliana* PDF2 (PROTODERMAL FACTOR2) promoter sequence |
| 53 | GM-PDF2 | *Glycine max* PDF2 (PROTODERMAL FACTOR2) promoter sequence |
| 54 | GM-PDF2 (TRUNCATED) | *Glycine max* PDF2 (PROTODERMAL FACTOR2) promoter sequence (TRUNCATED) |
| 55 | ZM-GL1 | *Zea mays* GL1 (GLABROUS1) promoter sequence |
| 56 | AT-PDF2a | *Arabidopsis thaliana* PDF2a (PROTODERMAL FACTOR2a) promoter sequence |
| 57 | AT-PDF2a (TRUNCATED) | *Arabidopsis thaliana* PDF2a (PROTODERMAL FACTOR2a) promoter sequence (TRUNCATED) |
| 58 | GM-PDF2a | *Glycine max* PDF2a (PROTODERMAL FACTOR2a) promoter sequence |
| 59 | GM-PDF2a (TRUNCATED) | *Glycine max* PDF2a (PROTODERMAL FACTOR2a) promoter sequence (TRUNCATED) |
| 60 | OS-PDF2 | *Oryza sativa* PDF2 (PROTODERMAL FACTOR2) promoter sequence |
| 61 | OS-PDF2 (TRUNCATED) | *Oryza sativa* PDF2 (PROTODERMAL FACTOR2) promoter sequence (TRUNCATED) |
| 62 | PT-PDF2 | *Populus trichocarpa* PDF2 (PROTODERMAL FACTOR2) promoter sequence) |
| 63 | PT-PDF2 (TRUNCATED) | *Populus trichocarpa* PDF2 (PROTODERMAL FACTOR2) promoter sequence (TRUNCATED) |
| 64 | VV-PDF2 | *Vitus vinifera* PDF2 (PROTODERMAL FACTOR2) promoter sequence |
| 65 | VV-PDF2 (TRUNCATED) | *Vitus vinifera* PDF2 (PROTODERMAL FACTOR2) promoter sequence (TRUNCATED) |
| 66 | ZM-PDF2 | *Zea mays* PDF2 (PROTODERMAL FACTOR2) promoter sequence |
| 67 | SI-PDF2 | *Setaria italica* PDF2 (PROTODERMAL FACTOR2) promoter sequence |
| 68 | SI-PDF2 (TRUNCATED) | *Setaria italica* PDF2 (PROTODERMAL FACTOR2) promoter sequence(TRUNCATED) |
| 69 | VV-PDF2a | *Vitus vinifera* PDF2a (PROTODERMAL FACTOR2a) promoter sequence |
| 70 | PT-PDF2a | *Populus trichocarpa* PDF2a (PROTODERMAL FACTOR2a) promoter sequence |
| 71 | PT-PDF2a (TRUNCATED) | *Populus trichocarpa* PDF2a (PROTODERMAL FACTOR2a) promoter sequence (TRUNCATED) |

TABLE 5-continued

| SEQ ID NO: | Promoter Name | Description |
|---|---|---|
| 72 | MT-PDF2 | *Medicago truncatula* PDF2 (PROTODERMAL FACTOR2) promoter sequence |
| 73 | MT-PDF2 (TRUNCATED) | *Medicago truncatula* PDF2 (PROTODERMAL FACTOR2) promoter sequence (TRUNCATED) |
| 74 | AT-HDG2 | *Arabidopsis thaliana* HDG2 (HOMEODOMAIN GLABROUS2) promoter sequence |
| 75 | GM-HDG2 | *Glycine max* HDG2 (HOMEODOMAIN GLABROUS2) promoter sequence |
| 76 | GM-HDG2 (TRUNCATED) | *Glycine max* HDG2 (HOMEODOMAIN GLABROUS2) promoter sequence (TRUNCATED) |
| 77 | SB-HDG2 | *Sorghum bicolor* HDG2 (HOMEODOMAIN GLABROUS2) promoter sequence |
| 78 | SB-HDG2 (TRUNCATED) | *Sorghum bicolor* HDG2 (HOMEODOMAIN GLABROUS2) promoter sequence (TRUNCATED) |
| 79 | AT-CER6 | *Arabidopsis thaliana* CER6 (ECERIFERUM6) promoter sequence |
| 80 | AT-CER60 | *Arabidopsis thaliana* CER60 (ECERIFERUM60) promoter sequence |
| 81 | AT-CER60 (TRUNCATED) | *Arabidopsis thaliana* CER60 (ECERIFERUM60) promoter sequence (TRUNCATED) |
| 82 | GM-CER6 | *Glycine max* CER6 (ECERIFERUM6) promoter sequence |
| 83 | GM-CER6 (TRUNCATED) | *Glycine max* CER6 (ECERIFERUM6) promoter sequence (TRUNCATED) |
| 84 | PT-CER6 | *Populus trichocarpa* CER6 (ECERIFERUM6) promoter sequence |
| 85 | PT-CER6 (TRUNCATED) | *Populus trichocarpa* CER6 (ECERIFERUM6) promoter sequence (TRUNCATED) |
| 86 | VV-CER6 | *Vitis vinifera* CER6 (ECERIFERUM6) promoter sequence |
| 87 | VV-CER6 (TRUNCATED) | *Vitis vinifera* CER6 (ECERIFERUM6) promoter sequence (TRUNCATED) |
| 88 | SB-CER6 | *Sorghum bicolor* CER6 (ECERIFERUM6) promoter sequence |
| 89 | ZM-CER6 | *Zea mays* CER6 (ECERIFERUM6) promoter sequence |
| 90 | SI-CER6 | *Setaria italica* CER6 (ECERIFERUM6) promoter sequence |
| 91 | SI-CER6 (TRUNCATED) | *Setaria italica* CER6 (ECERIFERUM6) promoter sequence (TRUNCATED) |
| 92 | OS-CER6 | *Oryza sativa* CER6 (ECERIFERUM6) promoter sequence |
| 93 | OS-CER6 (TRUNCATED) | *Oryza sativa* CER6 (ECERIFERUM6) promoter sequence (TRUNCATED) |
| 94 | GM-HBSTART2 | *Glycine max* HBSTART2 (Homeodomain StAR-related lipid transfer2) promoter sequence |
| 95 | GM-MATE1 | *Glycine max* MATE1 (Multi-antimicrobial extrusion protein1) promoter sequence |
| 96 | GM-NED1 | *Glycine max* NED1 (NAD dependent epimerase/dehydratase1) promoter sequence |
| 97 | GM-LTP3 | *Glycine max* LTP3 (Lipid Transfer Protein3) promoter sequence |
| 98 | SB-GL1 | *Sorghum bicolor* GL1 (GLABROUS1) promoter sequence |
| 99 | OS-GL1 | *Oryza sativa* GL1 (GLABROUS1) promoter sequence |
| 100 | AT-GL1 | *Arabidopsis thaliana* GL1 (GLABROUS1) promoter sequence |
| 101 | GM-GL1 | *Glycine max* GL1 (GLABROUS1) promoter sequence |
| 102 | AT-ANL1 | *Arabidopsis thaliana* ANL1 (ANTHOCYANLESS1) promoter sequence |
| 103 | ZM-OCL1 | *Zea mays* OCL1 (OUTER CELL LAYER1) promoter sequence |
| 104 | OS-OCL1 | *Oryza sativa* OCL1 (OUTER CELL LAYER1) promoter sequence |
| 105 | HV-LTP2 | *Hordeum vulgare* LTP2 (LIPID-TRANSFER PROTEIN) promoter sequence |
| 106 | SI-LTP2 | *Setaria italic* LTP2 (LIPID-TRANSFER PROTEIN) promoter sequence |

As used herein, the term "regulatory element" also refers to a sequence of DNA, usually, but not always, upstream (5') to the coding sequence of a structural gene, which includes sequences which control the expression of the coding region by providing the recognition for RNA polymerase and/or other factors required for transcription to start at a particular site. An example of a regulatory element that provides for the recognition for RNA polymerase or other transcriptional factors to ensure initiation at a particular site is a promoter element. A promoter element comprises a core promoter element, responsible for the initiation of transcription, as well as other regulatory elements that modify gene expression. It is to be understood that nucleotide sequences, located within introns or 3' of the coding region sequence may also contribute to the regulation of expression of a coding region of interest. Examples of suitable introns include, but are not limited to, the maize IVS6 intron, or the maize actin intron. A regulatory element may also include those elements located downstream (3') to the site of transcription initiation, or within transcribed regions, or both. In the context of the methods of the present disclosure a post-transcriptional regulatory element may include elements that are active following transcription initiation, for example translational and transcriptional enhancers, translational and transcriptional repressors and mRNA stability determinants.

A "heterologous nucleotide sequence", "heterologous polynucleotide of interest", "heterologous polynucleotide", or "heterologous trait gene" as used throughout the present disclosure, is a sequence that is not naturally occurring with or operably linked to a promoter. While this nucleotide sequence or trait gene is heterologous to the promoter sequence, it may be homologous or native or heterologous or foreign to the plant host. Likewise, the promoter sequence may be homologous or native or heterologous or foreign to the plant host and/or the polynucleotide of interest.

Expression modulating elements are useful in the methods of the present disclosure. "Expression modulating/modulation element" or "EME" as used herein refers to a nucleotide sequence that up or down-regulates the expression of one or more plant genes. An EME may have one or more copies of the same sequence arranged head-to-head, tail-to-head, or head-to-tail or a combination thereof of configurations. EMEs are derived from plant sequences, or from bacterial or viral enhancer elements. Expression modulating elements increase or decrease expression of operably linked nucleotide sequences.

Methods for construction of chimeric and variant EMEs useful in the methods of the present disclosure include, but are not limited to, combining EME elements of different EMEs or duplicating portions or regions of one or more EMEs. Those of skill in the art are familiar with the standard resource materials that describe specific conditions and procedures for the construction, manipulation, and isolation of macromolecules (e.g., polynucleotide molecules and plasmids), as well as the generation of recombinant organisms and the screening and isolation of polynucleotide molecules.

Recombinant DNA constructs can be constructed by operably linking the nucleic acid fragment of the EMEs disclosed herein or a fragment that is substantially similar and functionally equivalent to any portion of the nucleotide sequence set forth in SEQ ID NOS: 107-174 to a heterologous nucleic acid fragment. Any heterologous nucleic acid fragment can be used. The selection of heterologous nucleic acid fragment will depend upon the desired application or phenotype to be achieved. The various nucleic acid sequences can be manipulated so as to provide for the nucleic acid sequences in the proper orientation.

EMEs useful in the methods of the present disclosure include, but are not limited to, those listed in Table 6.

TABLE 6

| SEQ ID NO: | Name | Size (bp) | SEQUENCE 5'-3' |
|---|---|---|---|
| 107 | EME 1 | 17 | TGACGTAAGGTATGACG |
| 108 | EME 2 | 14 | CGTAAGGTATGACG |
| 109 | EME 3 | 22 | AACAACGTAAGCGCTTACGCAC |

TABLE 6-continued

| SEQ ID NO: | Name | Size (bp) | SEQUENCE 5'-3' |
|---|---|---|---|
| 110 | EME 4 | 16 | ACGTAAGCGCTTACGC |
| 111 | EME 5 | 14 | CGTAAGCGCTTACG |
| 112 | EME 6 | 14 | CGTAAACAAATACG |
| 113 | EME 7 | 14 | CGTAAACGCTTACG |
| 114 | EME 8 | 17 | TGACGTATGGTATGACG |
| 115 | EME 9 | 14 | CGTAAGGTCTTACG |
| 116 | EME 10 | 14 | CGTAAGTCCTTACG |
| 117 | EME 11 | 14 | CGTAAGTGCTTACG |
| 118 | EME 12 | 14 | CGTAAGGCCTTACG |
| 119 | EME 13 | 14 | CGTAAGACCTTACG |
| 120 | EME 14 | 14 | CGTAAGGACTTACG |
| 121 | EME 15 | 14 | CGTAAGCACTTACG |
| 122 | EME 16 | 14 | CGTAAGGGCTTACG |
| 123 | EME 17 | 14 | CGTAAGCCCTTACG |
| 124 | EME 18 | 14 | CGTAAGTACTTACG |
| 125 | EME 19 | 14 | CGTAAGATCTTACG |
| 126 | EME 20 | 16 | GCGTAAGCGCTTACGC |
| 127 | EME 21 | 16 | AAGTAAGCGCTTACTT |
| 128 | EME 22 | 16 | ACTTAAGCGCTTAAGT |
| 129 | EME 23 | 16 | ACGGAAGCGCTTCCGT |
| 130 | EME 24 | 16 | ACGTGAGCGCTCACGT |
| 131 | EME 25 | 16 | ACGTAGGCGCCTACGT |
| 132 | EME 26 | 16 | ACGTAATCGATTACGT |
| 133 | EME 27 | 16 | GATCGGTATACCGATC |
| 134 | EME 28 | 8 | GCTTACGT |
| 135 | EME 29 | 8 | ACGTAAGC |
| 136 | EME 30 | 16 | ACGTAAGCGCTTACGT |
| 137 | EME 31 | 20 | ACAACGTAAGCGCTTACGCA |
| 138 | EME 32 | 18 | CAACGTAAGCGCTTACGC |
| 139 | EME 33 | 15 | ACGTAAGCGCTTACG |
| 140 | EME 34 | 15 | CGTAAGCGCTTACGC |
| 141 | EME 35 | 13 | CGTAAGCGCTTAC |
| 142 | EME 36 | 13 | GTAAGCGCTTACG |
| 143 | EME 37 | 10 | TAAGCGCTTA |
| 144 | EME 38 | 8 | AAGCGCTT |
| 145 | EME 39 | 21 | CTGACGTAAGGGATGACGCAC |
| 146 | EME 40 | 16 | GACGTAAGGTATGACG |
| 147 | EME 41 | 15 | ACGTAAGGTATGACG |
| 148 | EME 42 | 13 | GTAAGGTATGACG |

TABLE 6-continued

| SEQ ID NO: | Name | Size (bp) | SEQUENCE 5'-3' |
|---|---|---|---|
| 149 | EME 43 | 12 | TAAGGTATGACG |
| 150 | EME 44 | 21 | CTGACGTAAGCGCTTACGTAC |
| 151 | EME 45 | 21 | CTGACGTAAGCGCTGACGTAC |
| 152 | EME 46 | 21 | CTGACGTAAGCGCTGACGCAC |
| 153 | EME 47 | 16 | ACGTAAGCGATTACGT |
| 154 | EME 48 | 21 | CTGACGTAAGCGATTACGCAC |
| 155 | EME 49 | 21 | CTGACGTAAGCGATTACGTAC |
| 156 | EME 50 | 21 | CTGACGTAAGGGATTACGTAC |
| 157 | EME 51 | 22 | AATGACGTAAGCGCTTACGCAC |
| 158 | EME 52 | 22 | AATGACGTAAGCGCTGACGCAC |
| 159 | EME 53 | 12 | CGTAAGGTATGA |
| 160 | EME 54 | 12 | GTAAGGTATGAC |
| 161 | EME 55 | 12 | GACGTAAGGTAT |
| 162 | EME 56 | 13 | ACGTAAGGTATGA |
| 163 | EME 57 | 13 | CGTAAGGTATGAC |
| 164 | EME 58 | 13 | GACGTAAGGTATG |
| 165 | EME 59 | 14 | ACGTAAGGTATGAC |
| 166 | EME 60 | 14 | GACGTAAGGTATGA |
| 167 | EME 61 | 15 | GACGTAAGGTATGAC |
| 168 | EME 62 | 11 | TAAGCGCTTAC |
| 169 | EME 63 | 12 | GTAAGCGCTTAC |
| 170 | EME 64 | 12 | TAAGCGCTTACG |
| 171 | EME 65 | 14 | GTAAGCGCTTACGC |
| 172 | EME 66 | 16 | AACGTAAGCGCTTACG |
| 173 | EME 67 | 16 | ACGTAAGCGCTTACGA |
| 174 | EME 68 | 16 | ACGTAAGCGCTTACGG |

The DNA constructs/expression cassettes useful in the methods of the present disclosure can also include further enhancers, either translation or transcription enhancers, as may be required. These enhancer regions are well known to persons skilled in the art and can include the ATG initiation codon and adjacent sequences. The initiation codon must be in phase with the reading frame of the coding sequence to ensure translation of the entire sequence. The translation control signals and initiation codons can be from a variety of origins, both natural and synthetic. Translational initiation regions may be provided from the source of the transcriptional initiation region, or from the structural gene. The sequence can also be derived from the regulatory element selected to express the gene and can be specifically modified to increase translation of the mRNA. It is recognized that to increase transcription levels enhancers may be utilized in combination with promoter regions. It is recognized that to increase transcription levels, enhancers may be utilized in combination with promoter regions. Enhancers are nucleotide sequences that act to increase the expression of a promoter region. Enhancers are known in the art and include the SV40 enhancer region, the 35S enhancer element and the like. Multiple enhancers or multiple copies of the same enhancer are useful in the methods of the present disclosure. Some enhancers are also known to alter normal promoter expression patterns, for example, by causing a promoter to be expressed constitutively when without the enhancer, the same promoter is expressed only in one specific tissue or a few specific tissues. Enhancers useful in the methods of the present disclosure are listed in Table 7 below.

TABLE 7

| SEQ ID NO: | Description |
|---|---|
| 175 | CaMV35S Enhancer (CAMV35S ENH) |
| 176 | Citrus Yellow Mosaic Virus Enhancer (CYMV ENH) |
| 177 | Banana Streak Virus Enhancer (BSV(AY) ENH) |
| 178 | Figwort Mosaic Virus Enhancer (FMV ENH) |
| 179 | Peanut Chlorotic Streak Virus Enhancer (PCSV ENH) |
| 180 | Mirabilis Mosaic Virus Enhancer (MMV ENH) |

Generally, a "weak promoter" means a promoter that drives expression of a coding sequence at a low level. A "low level" of expression is intended to mean expression at levels of about $1/10,000$ transcripts to about $1/100,000$ transcripts to about $1/500,000$ transcripts. Conversely, a strong promoter drives expression of a coding sequence at a high level, or at about $1/10$ transcripts to about $1/100$ transcripts to about $1/1,000$ transcripts.

It is recognized that sequences useful in the methods of the present disclosure may be used with their native coding sequences thereby resulting in a change in phenotype of the transformed plant. The morphogenic genes and genes of interest disclosed herein, as well as variants and fragments thereof, are useful in the methods of the present disclosure for the genetic manipulation of any plant. The term "operably linked" means that the transcription or translation of a heterologous nucleotide sequence is under the influence of a promoter sequence.

In one aspect of the present disclosure, expression cassettes comprise a transcriptional initiation region or variants or fragments thereof, operably linked to a morphogenic gene and/or a heterologous nucleotide sequence. Such expression cassettes can be provided with a plurality of restriction sites for insertion of the nucleotide sequence to be under the transcriptional regulation of the regulatory regions. The expression cassettes may additionally contain selectable marker genes as well as 3' termination regions.

The expression cassettes can include, in the 5'-3' direction of transcription, a transcriptional initiation region (i.e., a promoter, or variant or fragment thereof), a translational initiation region, a morphogenic gene and/or a heterologous nucleotide sequence of interest, a translational termination region and optionally, a transcriptional termination region functional in the host organism. The regulatory regions (i.e., promoters, transcriptional regulatory regions, and translational termination regions), the morphogenic gene and/or the polynucleotide of interest useful in the methods of the present disclosure may be native/analogous to the host cell or to each other. Alternatively, the regulatory regions, morphogenic gene and/or the polynucleotide of interest may be heterologous to the host cell or to each other. As used herein, "heterologous" in reference to a sequence is a sequence that originates from a foreign species or, if from the same species, is substantially modified from its native form in composition and/or genomic locus by deliberate human intervention. For example, a promoter operably linked to a heterologous polynucleotide is from a species different from the species from which the polynucleotide was derived or, if from the same/analogous species, one or both are substantially modified from their original form and/or genomic locus or the promoter is not the native promoter for the operably linked polynucleotide.

The termination region may be native with the transcriptional initiation region, may be native with the operably linked morphogenic gen and/or may be native with the operably linked DNA sequence of interest, may be native with the plant host, or may be derived from another source (i.e., foreign or heterologous to the promoter, the morphogenic gene and/or the DNA sequence being expressed, the plant host, or any combination thereof). Convenient termination regions are available from the Ti-plasmid of $A.$ $tumefaciens$, such as the octopine synthase and nopaline synthase termination regions. See also, Guerineau, et al., (1991) Mol. Gen. Genet. 262:141-144; Proudfoot, (1991) Cell 64:671-674; Sanfacon, et al., (1991) Genes Dev. 5:141-149; Mogen, et al., (1990) Plant Cell 2:1261-1272; Munroe, et al., (1990) Gene 91:151-158; Ballas, et al., (1989) Nucleic Acids Res. 17:7891-7903; and Joshi, et al., (1987) Nucleic Acid Res. 15:9627-9639, herein incorporated by reference in their entirety.

The expression cassette comprising a promoter operably linked to a morphogenic gene and/or optionally further operably linked to a heterologous nucleotide sequence, a heterologous polynucleotide of interest, a heterologous polynucleotide nucleotide, a sequence of interest, or a trait gene can be used to transform any plant. Alternatively, a heterologous polynucleotide of interest, a heterologous polynucleotide nucleotide, a sequence of interest, or a trait gene operably linked to a promoter can be on a separate expression cassette positioned outside of the transfer-DNA (T-DNA). In this manner, genetically modified plants, plant cells, plant tissue, seed, root and the like can be obtained. The expression cassette comprising the sequences of the present disclosure may also contain at least one additional nucleotide sequence for a gene, heterologous nucleotide sequence, heterologous polynucleotide of interest, or heterologous polynucleotide to be cotransformed into the organism. Alternatively, the additional nucleotide sequence(s) can be provided on another expression cassette.

Where appropriate, the nucleotide sequences/trait genes whose expression is to be under the control a promoter sequence and any additional nucleotide sequence(s) may be optimized for increased expression in the transformed plant. That is, these nucleotide sequences can be synthesized using plant preferred codons for improved expression. See, for example, Campbell and Gowri, (1990) Plant Physiol. 92:1-11, herein incorporated by reference in its entirety, for a discussion of host-preferred codon usage. Methods are available in the art for synthesizing plant-preferred genes. See, for example, U.S. Pat. Nos. 5,380,831, 5,436,391 and Murray, et al., (1989) Nucleic Acids Res. 17:477-498, herein incorporated by reference in their entirety.

Additional sequence modifications are known to enhance gene expression in a cellular host. These include elimination of sequences encoding spurious polyadenylation signals, exon-intron splice site signals, transposon-like repeats and other such well-characterized sequences that may be deleterious to gene expression. The G-C content of a heterologous nucleotide sequence may be adjusted to levels average for a given cellular host, as calculated by reference to known genes expressed in the host cell. When possible, the sequence is modified to avoid predicted hairpin secondary mRNA structures.

As used herein, "vector" refers to a DNA molecule such as a plasmid, cosmid or bacterial phage for introducing a nucleotide construct, for example, an expression cassette, into a host cell. Cloning vectors typically contain one or a small number of restriction endonuclease recognition sites at which foreign DNA sequences can be inserted in a determinable fashion without loss of essential biological function of the vector, as well as a marker gene that is suitable for use in the identification and selection of cells transformed with the cloning vector. Marker genes typically include genes that provide tetracycline resistance, hygromycin resistance or ampicillin resistance.

In an aspect, haploid cells can be contacted with an amount of a chromosome doubling agent to promote chromosome doubling followed by regenerating homozygous diploid plants from the treated haploid cells. The haploid microspore cells can be in contact with the doubling agent before, during, or after initiation of microspore embryogenesis or embryo maturation. After chromosome doubling, the doubled haploid embryo will contain 2 copies of paternally derived chromosomes. The efficiency of the process for obtaining doubled haploid plants from haploid embryos may be greater than 10%, 20%, 30%, 50%, 60%, 70%, 80%, or 90%. The duration of contact between the haploid cells and the chromosomal doubling agent may vary. Contact may be from less than 24 hours, for example 4-12 hours, to about a week. The duration of contact is generally from about 8 hours to 2 days.

Methods of chromosome doubling are disclosed in Antoine-Michard, S. et al., Plant cell, tissue organ cult, Cordrecht, the Netherlands, Kluwer Academic Publishers, 1997, 48(3):203-207; Kato, A., Maize Genetics Cooperation Newsletter 1997, 36-37; and Wan, Y. et al., TAG, 1989, 77: 889-892. Wan, Y. et al., TAG, 1991, 81: 205-211. The disclosures of which are incorporated herein by reference. Typical doubling methods involve contacting the cells with colchicine, anti-microtubule agents or anti-microtubule herbicides, pronamide, nitrous oxide, or any mitotic inhibitor to create homozygous doubled haploid cells. The amount of colchicine used in medium is generally 0.01%-0.2% or approximately 0.05% of amiprophos-methyl (APM) (5-225 µM) may be used. The amount of colchicine can range from approximately 400-600 mg/L or approximately 500 mg/L. The amount of pronamide in medium is approximately 0.5-20 µM. Examples of mitotic inhibitors are included in Table 8. Other agents may be used with the mitotic inhibitors to improve doubling efficiency. Such agents include dimethyl sulfoxide (DMSO), adjuvants, surfactants, and the like.

TABLE 8

| Common Name/ Trade name | CAS | IUPAC |
|---|---|---|
| Colchicine and Colchicine Derivatives | | |
| colchicine/ acetyltrimethylcolchicinic acid colchicine derivatives | | (S)-N-(5,6,7,9-tetrahydro-1,2,3,10-tetramethoxy-9-oxobenzo (a) heptalen-7-yl) acetamide |

TABLE 8-continued

| Common Name/ Trade name | CAS | IUPAC |
|---|---|---|
| Carbamates | | |
| Carbetamide | (R)-1-(ethylcarbamoyl)ethyl carbanilate | (2R)-N-ethyl-2-[[(phenylamino)carbonyl]oxy]propanamide |
| chloropropham | | |
| Propham | | |
| Benzamides | | |
| Pronamide/ propyzamide | 3,5-dichloro-N-(1,1-dimethylpropynyl)benzamide | 3,5-dichloro-N-(1,1-dimethyl-2-propynyl)benzamide |
| Tebutam | | |
| Benzoic Acids | | |
| Chlorthal dimethyl (DCPA), Dicamba/dianat/ disugran (dicamba-methyl) (BANVEL, CLARITY) | 3,6-dichloro-o-anisic acid | 3,6-dichloro-2-methoxybenzoic acid |
| Dinitroaniline chromosome doubling agents | | |
| benfluralin/benefin/ (BALAN) | N-butyl-N-ethyl-α,α,α-trifluoro-2,6-dinitro-p-toluidine | N-butyl-N-ethyl-2,6-dinitro-4-(trifluoromethyl)benzenamine |
| Butralin | (RS)-N-sec-butyl-4-tert-butyl-2,6-dinitroaniline | 4-(1,1-dimethylethyl)-N-(1-methylpropyl)-2,6-dinitrobenzenamine |
| Chloralin | | |
| dinitramine | N1,N1-diethyl-2,6-dinitro-4-trifluoromethyl-m-phenylenediamine | N3,N3-diethyl-2,4-dinitro-6-(trifluoromethyl)-1,3-benzenediamine |
| ethalfluralin (Sonalan) | N-ethyl-α,α,α-trifluoro-N-(2-methylallyl)-2,6-dinitro-p-toluidine | N-ethyl-N-(2-methyl-2-propenyl)-2,6-dinitro-4-(trifluoromethyl)benzenamine |
| fluchloralin | N-(2-chloroethyl)-2,6-dinitro-N-propyl-4-(trifluoromethyl)aniline or N-(2-chloroethyl)-α,α,α-trifluoro-2,6-dinitro-N-propyl-p-toluidine | N-(2-chloroethyl)-2,6-dinitro-N-propyl-4-(trifluoromethyl)benzenamine |
| isopropalin | 4-isopropyl-2,6-dinitro-N,N-dipropylaniline | 4-(1-methylethyl)-2,6-dinitro-N,N-dipropylbenzenamine |
| methalpropalin | α,α,α-trifluoro-N-(2-methylallyl)-2,6-dinitro-N-propyl-p-toluidine | N-(2-methyl-2-propenyl)-2,6-dinitro-N-propyl-4-(trifluoromethyl)benzenamine |
| nitralin | 4-methylsulfonyl-2,6-dinitro-N,N-dipropylaniline | 4-(methylsulfonyl)-2,6-dinitro-N,N-dipropylbenzenamine |
| oryzalin (SURFLAN) | 3,5-dinitro-N4,N4-dipropylsulfanilamide | 4-(dipropylamino)-3,5-dinitrobenzenesulfonamide |
| pendimethalin (PROWL) | N-(1-ethylpropyl)-2,6-dinitro-3,4-xylidine | N-(1-ethylpropyl)-3,4-dimethyl-2,6-dinitrobenzenamine |
| prodiamine | 5-dipropylamino-α,α,α-trifluoro-4,6-dinitro-o-toluidine or 2,6-dinitro-N1,N1-dipropyl-4-trifluoromethyl-m-phenylenediamine | 2,4-dinitro-N3,N3-dipropyl-6-(trifluoromethyl)-1,3-benzenediamine |
| profluralin | N-cyclopropylmethyl-α,α,α-trifluoro-2,6-dinitro-N-propyl-p-toluidine or N-cyclopropylmethyl-2,6-dinitro-N-propyl-4-trifluoromethyl aniline | N-(cyclopropylmethyl)-2,6-dinitro-N-propyl-4-(trifluoromethyl)benzenamine |
| trifluralin (TREFLAN, TRIFIC, TRILLIN ) | α,α,α-trifluoro-2,6-dinitro-N,N-dipropyl-p-toluidine | 2,6-dinitro-N,N-dipropyl-4-(trifluoromethyl)benzenamine |
| Phosphoroamidates | | |
| APM (Amiprofos methyl); amiprophos-methyl | | |
| Butamifos | O-ethyl O-6-nitro-m-tolyl (RS)-sec-butylphosphoramidothioate | O-ethyl O-(5-methyl-2-nitrophenyl) (1-methylpropyl)phosphoramidothioate |

TABLE 8-continued

| Common Name/ Trade name | CAS | IUPAC |
|---|---|---|
| Pyridines | | |
| Dithiopyr Thiazopyr | methyl 2-difluoromethyl-5-(4,5-dihydro-1,3-thiazol-2-yl)-4-isobutyl-6-trifluoromethylnicotinate | methyl 2-(difluoromethyl)-5-(4,5-dihydro-2-thiazolyl)-4-(2-methylpropyl)-6-(trifluoromethyl)-3-pyridinecarboxylate |

Cells that have been transformed may be grown into plants in accordance with conventional ways. See, for example, McCormick, et al., (1986) Plant Cell Reports 5:81-84, herein incorporated by reference in its entirety. These plants may then be grown, and either pollinated with the same transformed strain or different strains, and the resulting progeny having expression of the desired phenotypic characteristic identified. Two or more generations may be grown to ensure that expression of the desired phenotypic characteristic is stably maintained and inherited and then seeds harvested to ensure expression of the desired phenotypic characteristic has been achieved. In this manner, the present disclosure provides transformed seed (also referred to as "transgenic seed") having a nucleotide construct useful in the methods of the present disclosure, for example, an expression cassette useful in the methods of the present disclosure, stably incorporated into its genome.

There are a variety of methods for the regeneration of plants from plant tissue. The particular method of regeneration will depend on the starting plant tissue and the particular plant species to be regenerated. The regeneration, development and cultivation of plants from single plant protoplast transformants or from various transformed explants is well known in the art (Weissbach and Weissbach, (1988) In: Methods for Plant Molecular Biology, (Eds.), Academic Press, Inc., San Diego, Calif., herein incorporated by reference in its entirety). This regeneration and growth process typically includes the steps of selection of transformed cells, culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil. Preferably, the regenerated plants are self-pollinated to provide homozygous transgenic plants. Otherwise, pollen obtained from the regenerated plants is crossed to seed-grown plants of agronomically important lines. Conversely, pollen from plants of these important lines is used to pollinate regenerated plants. A transgenic plant produced by the methods of the present disclosure containing a desired polynucleotide of interest is cultivated using methods well known to one skilled in the art.

Methods are known in the art for the targeted insertion of a polynucleotide at a specific location in the plant genome. The insertion of the polynucleotide at a desired genomic location is achieved using a site-specific recombination system. See, for example, WO99/25821, WO99/25854, WO99/25840, WO99/25855 and WO99/25853, all of which are herein incorporated by reference in their entirety. Briefly, a polynucleotide of interest, flanked by two non-identical recombination sites, can be contained in a T-DNA transfer cassette. The T-DNA transfer cassette is introduced into a plant having stably incorporated into its genome a target site which is flanked by two non-identical recombination sites that correspond to the sites of the transfer cassette. An appropriate recombinase is provided, and the transfer cassette is integrated at the target site. The polynucleotide of interest is thereby integrated at a specific chromosomal position in the plant genome.

The disclosed methods can be used to introduce into explants polynucleotides that are useful to target a specific site for modification in the genome of a plant derived from the explant. Site specific modifications that can be introduced with the disclosed methods include those produced using any method for introducing site specific modification, including, but not limited to, through the use of gene repair oligonucleotides (e.g. US Publication 2013/0019349), or through the use of double-stranded break technologies such as TALENs, meganucleases, zinc finger nucleases, CRISPR-Cas, and the like. For example, the disclosed methods can be used to introduce a CRISPR-Cas system into a plant cell or plant, for the purpose of genome modification of a target sequence in the genome of a plant or plant cell, for selecting plants, for deleting a base or a sequence, for gene editing, and for inserting a polynucleotide of interest into the genome of a plant or plant cell. Thus, the disclosed methods can be used together with a CRISPR-Cas system to provide for an effective system for modifying or altering target sites and nucleotides of interest within the genome of a plant, plant cell or seed. The Cas endonuclease gene is a plant optimized Cas9 endonuclease, wherein the plant optimized Cas9 endonuclease is capable of binding to and creating a double strand break in a genomic target sequence of the plant genome.

The Cas endonuclease is guided by the guide nucleotide to recognize and optionally introduce a double strand break at a specific target site into the genome of a cell. The CRISPR-Cas system provides for an effective system for modifying target sites within the genome of a plant, plant cell or seed. Further provided are methods employing a guide polynucleotide/Cas endonuclease system to provide an effective system for modifying target sites within the genome of a cell and for editing a nucleotide sequence in the genome of a cell. Once a genomic target site is identified, a variety of methods can be employed to further modify the target sites such that they contain a variety of polynucleotides of interest. The disclosed methods can be used to introduce a CRISPR-Cas system for editing a nucleotide sequence in the genome of a cell. The nucleotide sequence to be edited (the nucleotide sequence of interest) can be located within or outside a target site that is recognized by a Cas endonuclease.

CRISPR loci (Clustered Regularly Interspaced Short Palindromic Repeats) (also known as SPIDRs-SPacer Interspersed Direct Repeats) constitute a family of recently described DNA loci. CRISPR loci consist of short and highly conserved DNA repeats (typically 24 to 40 bp, repeated from 1 to 140 times—also referred to as CRISPR-repeats) which are partially palindromic. The repeated sequences (usually specific to a species) are interspaced by variable sequences of constant length (typically 20 to 58 by depending on the CRISPR locus (WO2007/025097 published Mar. 1, 2007).

Cas gene includes a gene that is generally coupled, associated or close to or in the vicinity of flanking CRISPR loci. The terms "Cas gene" and "CRISPR-associated (Cas) gene" are used interchangeably herein.

In another aspect, the Cas endonuclease gene is operably linked to a SV40 nuclear targeting signal upstream of the Cas codon region and a bipartite VirD2 nuclear localization signal (Tinland et al. (1992) Proc. Natl. Acad. Sci. USA 89:7442-6) downstream of the Cas codon region.

As related to the Cas endonuclease, the terms "functional fragment," "fragment that is functionally equivalent," and "functionally equivalent fragment" are used interchangeably herein. These terms refer to a portion or subsequence of the Cas endonuclease sequence in which the ability to create a double-strand break is retained.

As related to the Cas endonuclease, the terms "functional variant," "variant that is functionally equivalent" and "functionally equivalent variant" are used interchangeably herein. These terms refer to a variant of the Cas endonuclease in which the ability to create a double-strand break is retained. Fragments and variants can be obtained via methods such as site-directed mutagenesis and synthetic construction.

In an aspect, the Cas endonuclease gene is a plant codon optimized *Streptococcus pyogenes* Cas9 gene that can recognize any genomic sequence of the form N (12-30) NGG which can in principle be targeted.

Endonucleases are enzymes that cleave the phosphodiester bond within a polynucleotide chain and include restriction endonucleases that cleave DNA at specific sites without damaging the bases. Restriction endonucleases include Type I, Type II, Type III, and Type IV endonucleases, which further include subtypes. In the Type I and Type III systems, both the methylase and restriction activities are contained in a single complex. Endonucleases also include meganucleases, also known as homing endonucleases (HEases), which like restriction endonucleases, bind and cut at a specific recognition site, however the recognition sites for meganucleases are typically longer, about 18 bp or more (Patent application PCT/US 12/30061 filed on Mar. 22, 2012). Meganucleases have been classified into four families based on conserved sequence motifs. These motifs participate in the coordination of metal ions and hydrolysis of phosphodiester bonds. Meganucleases are notable for their long recognition sites, and for tolerating some sequence polymorphisms in their DNA substrates. The naming convention for meganuclease is similar to the convention for other restriction endonuclease. Meganucleases are also characterized by prefix F-, I-, or PI- for enzymes encoded by free-standing ORFs, introns, and inteins, respectively. One step in the recombination process involves polynucleotide cleavage at or near the recognition site. This cleaving activity can be used to produce a double-strand break. For reviews of site-specific recombinases and their recognition sites, see, Sauer (1994) Curr Op Biotechnol 5:521-7; and Sadowski (1993) FASEB 7:760-7. In some examples the recombinase is from the Integrase or Resolvase families. TAL effector nucleases are a new class of sequence-specific nucleases that can be used to make double-strand breaks at specific target sequences in the genome of a plant or other organism. (Miller, et al. (2011) Nature Biotechnology 29:143-148). Zinc finger nucleases (ZFNs) are engineered double-strand break inducing agents comprised of a zinc finger DNA binding domain and a double-strand-break-inducing agent domain. Recognition site specificity is conferred by the zinc finger domain, which typically comprising two, three, or four zinc fingers, for example having a C2H2 structure, however other zinc finger structures are known and have been engineered. Zinc finger domains are amenable for designing polypeptides which specifically bind a selected polynucleotide recognition sequence. ZFNs include an engineered DNA-binding zinc finger domain linked to a non-specific endonuclease domain, for example nuclease domain from a Type Ms endonuclease such as FokI. Additional functionalities can be fused to the zinc-finger binding domain, including transcriptional activator domains, transcription repressor domains, and methylases. In some examples, dimerization of nuclease domain is required for cleavage activity. Each zinc finger recognizes three consecutive base pairs in the target DNA. For example, a 3-finger domain recognized a sequence of 9 contiguous nucleotides, with a dimerization requirement of the nuclease, two sets of zinc finger triplets are used to bind an 18-nucleotide recognition sequence.

A "Dead-CAS9" (dCAS9) as used herein, is used to supply a transcriptional repressor domain. The dCAS9 has been mutated so that can no longer cut DNA. The dCAS0 can still bind when guided to a sequence by the gRNA and can also be fused to repressor elements. The dCAS9 fused to the repressor element, as described herein, is abbreviated to dCAS9~REP, where the repressor element (REP) can be any of the known repressor motifs that have been characterized in plants. An expressed guide RNA (gRNA) binds to the dCAS9~REP protein and targets the binding of the dCAS9-REP fusion protein to a specific predetermined nucleotide sequence within a promoter (a promoter within the T-DNA). For example, if this is expressed beyond-the border using a ZM-UBI PRO::dCAS9~REP::PINII TERM cassette along with a U6-POL PRO::gRNA::U6 TERM cassette and the gRNA is designed to guide the dCAS9-REP protein to bind the SB-UBI promoter in the expression cassette SB-UBI PRO::moPAT::PINII TERM within the T-DNA, any event that has integrated the beyond-the-border sequence would be bialaphos sensitive. Transgenic events that integrate only the T-DNA would express moPAT and be bialaphos resistant. The advantage of using a dCAS9 protein fused to a repressor (as opposed to a TETR or ESR) is the ability to target these repressors to any promoter within the T-DNA. TETR and ESR are restricted to cognate operator binding sequences. Alternatively, a synthetic Zinc-Finger Nuclease fused to a repressor domain can be used in place of the gRNA and dCAS9~REP (Urritia et al., 2003, Genome Biol. 4:231) as described above.

The type II CRISPR/Cas system from bacteria employs a crRNA and tracrRNA to guide the Cas endonuclease to its DNA target. The crRNA (CRISPR RNA) contains the region complementary to one strand of the double strand DNA target and base pairs with the tracrRNA (trans-activating CRISPR RNA) forming a RNA duplex that directs the Cas endonuclease to cleave the DNA target. As used herein, the term "guide nucleotide" relates to a synthetic fusion of two RNA molecules, a crRNA (CRISPR RNA) comprising a variable targeting domain, and a tracrRNA. In an aspect, the guide nucleotide comprises a variable targeting domain of 12 to 30 nucleotide sequences and a RNA fragment that can interact with a Cas endonuclease.

As used herein, the term "guide polynucleotide" relates to a polynucleotide sequence that can form a complex with a Cas endonuclease and enables the Cas endonuclease to recognize and optionally cleave a DNA target site. The guide polynucleotide can be a single molecule or a double molecule. The guide polynucleotide sequence can be a RNA sequence, a DNA sequence, or a combination thereof (a RNA-DNA combination sequence). Optionally, the guide polynucleotide can comprise at least one nucleotide, phosphodiester bond or linkage modification such as, but not limited, to Locked Nucleic Acid (LNA), 5-methyl dC, 2,6-Diaminopurine, 2'-Fluoro A, 2'-Fluoro U, 2'-O-Methyl RNA, phosphorothioate bond, linkage to a cholesterol molecule, linkage to a polyethylene glycol molecule, linkage to a spacer 18 (hexaethylene glycol chain) molecule, or 5' to 3' covalent linkage resulting in circularization. A guide polynucleotide that solely comprises ribonucleic acids is also referred to as a "guide nucleotide".

Nucleotide sequence modification of the guide polynucleotide, VT domain and/or CER domain can be selected from, but not limited to, the group consisting of a 5' cap, a 3' polyadenylated tail, a riboswitch sequence, a stability control sequence, a sequence that forms a dsRNA duplex, a modification or sequence that targets the guide poly nucleotide to a subcellular location, a modification or sequence that provides for tracking, a modification or sequence that provides a binding site for proteins, a Locked Nucleic Acid (LNA), a 5-methyl dC nucleotide, a 2,6-Diaminopurine nucleotide, a 2'-Fluoro A nucleotide, a 2'-Fluoro U nucleotide; a 2'-O-Methyl RNA nucleotide, a phosphorothioate bond, linkage to a cholesterol molecule, linkage to a polyethylene glycol molecule, linkage to a spacer 18 molecule, a 5' to 3' covalent linkage, or any combination thereof. These modifications can result in at least one additional beneficial feature, wherein the additional beneficial feature is selected from the group of a modified or regulated stability, a subcellular targeting, tracking, a fluorescent label, a binding site for a protein or protein complex, modified binding affinity to complementary target sequence, modified resistance to cellular degradation, and increased cellular permeability.

In an aspect, the guide nucleotide and Cas endonuclease are capable of forming a complex that enables the Cas endonuclease to introduce a double strand break at a DNA target site.

In an aspect of the present disclosure the variable target domain is 12, 13, 14, 15, 16, 17, 18, 19, 20, 21, 22, 23, 24, 25, 26, 27, 28, 29 or 30 nucleotides in length.

In an aspect of the present disclosure, the guide nucleotide comprises a cRNA (or cRNA fragment) and a tracrRNA (or tracrRNA fragment) of the type II CRISPR/Cas system that can form a complex with a type II Cas endonuclease, wherein the guide nucleotide Cas endonuclease complex can direct the Cas endonuclease to a plant genomic target site, enabling the Cas endonuclease to introduce a double strand break into the genomic target site. The guide nucleotide can be introduced into a plant or plant cell directly using any method known in the art such as, but not limited to, particle bombardment or topical applications.

In an aspect, the guide nucleotide can be introduced indirectly by introducing a recombinant DNA molecule comprising the corresponding guide DNA sequence operably linked to a plant specific promoter that is capable of transcribing the guide nucleotide in the plant cell. The term "corresponding guide DNA" includes a DNA molecule that is identical to the RNA molecule but has a "T" substituted for each "U" of the RNA molecule.

In an aspect, the guide nucleotide is introduced via particle bombardment or using the disclosed methods for Agrobacterium transformation of a recombinant DNA construct comprising the corresponding guide DNA operably linked to a plant U6 polymerase III promoter.

In an aspect, the RNA that guides the RNA Cas9 endonuclease complex, is a duplexed RNA comprising a duplex crRNA-tracrRNA. One advantage of using a guide nucleotide versus a duplexed crRNA-tracrRNA is that only one expression cassette needs to be made to express the fused guide nucleotide.

The terms "target site," "target sequence," "target DNA," "target locus," "genomic target site," "genomic target sequence," and "genomic target locus" are used interchangeably herein and refer to a polynucleotide sequence in the genome (including chloroplastic and mitochondrial DNA) of a plant cell at which a double-strand break is induced in the plant cell genome by a Cas endonuclease. The target site can be an endogenous site in the plant genome, or alternatively, the target site can be heterologous to the plant and thereby not be naturally occurring in the genome, or the target site can be found in a heterologous genomic location compared to where it occurs in nature.

As used herein, terms "endogenous target sequence" and "native target sequence" are used interchangeably herein to refer to a target sequence that is endogenous or native to the genome of a plant and is at the endogenous or native position of that target sequence in the genome of the plant.

An "artificial target site" or "artificial target sequence" are used interchangeably herein and refer to a target sequence that has been introduced into the genome of a plant. Such an artificial target sequence can be identical in sequence to an endogenous or native target sequence in the genome of a plant but be located in a different position (i.e., a non-endogenous or non-native position) in the genome of a plant.

An "altered target site," "altered target sequence" "modified target site," and "modified target sequence" are used interchangeably herein and refer to a target sequence as disclosed herein that comprises at least one alteration when compared to non-altered target sequence. Such "alterations" include, for example: (i) replacement of at least one nucleotide, (ii) a deletion of at least one nucleotide, (iii) an insertion of at least one nucleotide, or (iv) any combination of (i)-(iii).

In an aspect, the disclosed methods can be used to introduce into plants polynucleotides useful for gene suppression of a target gene in a plant. Reduction of the activity of specific genes (also known as gene silencing, or gene suppression) is desirable for several aspects of genetic engineering in plants. Many techniques for gene silencing are well known to one of skill in the art, including but not limited to antisense technology.

In an aspect, the disclosed methods can be used to introduce into plants polynucleotides useful for the targeted integration of nucleotide sequences into a plant. For example, the disclosed methods can be used to introduce T-DNA expression cassettes comprising nucleotide sequences of interest flanked by non-identical recombination sites are used to transform a plant comprising a target site. In an aspect, the target site contains at least a set of non-identical recombination sites corresponding to those on the T-DNA expression cassette. The exchange of the nucleotide sequences flanked by the recombination sites is affected by a recombinase. Thus, the disclosed methods can be used for the introduction of T-DNA expression cassettes for targeted integration of nucleotide sequences, wherein the T-DNA expression cassettes which are flanked by non-identical recombination sites recognized by a recombinase that recognizes and implements recombination at the non-identical recombination sites. Accordingly, the disclosed methods and composition can be used to improve efficiency and speed of development of plants containing non-identical recombination sites.

Thus, the disclosed methods can further comprise methods for the directional, targeted integration of exogenous nucleotides into a transformed plant. In an aspect, the disclosed methods use novel recombination sites in a gene targeting system which facilitates directional targeting of desired genes and nucleotide sequences into corresponding recombination sites previously introduced into the target plant genome.

In an aspect, a nucleotide sequence flanked by two non-identical recombination sites is introduced into one or more cells of an explant derived from the target organism's genome establishing a target site for insertion of nucleotide sequences of interest. Once a stable plant or cultured tissue is established a second construct, or nucleotide sequence of interest, flanked by corresponding recombination sites as those flanking the target site, is introduced into the stably transformed plant or tissues in the presence of a recombinase protein. This process results in exchange of the nucleotide sequences between the non-identical recombination sites of the target site and the T-DNA expression cassette.

It is recognized that the transformed plant prepared in this manner may comprise multiple target sites; i. e., sets of non-identical recombination sites. In this manner, multiple manipulations of the target site in the transformed plant are available. By target site in the transformed plant is intended a DNA sequence that has been inserted into the transformed plant's genome and comprises non-identical recombination sites.

Examples of recombination sites for use in the disclosed method are known. The two-micron plasmid found in most naturally occurring strains of Saccharomyces cerevisiae, encodes a site-specific recombinase that promotes an inversion of the DNA between two inverted repeats. This inversion plays a central role in plasmid copy-number amplification.

The protein, designated FLP protein, catalyzes site-specific recombination events. The minimal recombination site (FRT) has been defined and contains two inverted 13-base pair (bp) repeats surrounding an asymmetric 8-bp spacer. The FLP protein cleaves the site at the junctions of the repeats and the spacer and is covalently linked to the DNA via a 3'phosphate. Site specific recombinases like FLP cleave and relegate DNA at specific target sequences, resulting in a precisely defined recombination between two identical sites. To function, the system needs the recombination sites and the recombinase. No auxiliary factors are needed. Thus, the entire system can be inserted into and function in plant cells. The yeast FLP\FRT site specific recombination system has been shown to function in plants. To date, the system has been utilized for excision of unwanted DNA. See, Lyznik et al. (1993) Nucleic Acid Res. 21: 969-975. In contrast, the present disclosure utilizes non-identical FRTs for the exchange, targeting, arrangement, insertion and control of expression of nucleotide sequences in the plant genome.

In an aspect, a transformed organism of interest, such as an explant from a plant, containing a target site integrated into its genome is needed. The target site is characterized by being flanked by non-identical recombination sites. A targeting cassette is additionally required containing a nucleotide sequence flanked by corresponding non-identical recombination sites as those sites contained in the target site of the transformed organism. A recombinase which recognizes the non-identical recombination sites and catalyzes site-specific recombination is required.

It is recognized that the recombinase can be provided by any means known in the art. That is, it can be provided in the organism or plant cell by transforming the organism with an expression cassette capable of expressing the recombinase in the organism, by transient expression, or by providing messenger RNA (mRNA) for the recombinase or the recombinase protein.

By "non-identical recombination sites" it is intended that the flanking recombination sites are not identical in sequence and will not recombine or recombination between the sites will be minimal. That is, one flanking recombination site may be a FRT site where the second recombination site may be a mutated FRT site. The non-identical recombination sites used in the methods of the present disclosure prevent or greatly suppress recombination between the two flanking recombination sites and excision of the nucleotide sequence contained therein. Accordingly, it is recognized that any suitable non-identical recombination sites may be utilized in the present disclosure, including FRT and mutant FRT sites, FRT and lox sites, lox and mutant lox sites, as well as other recombination sites known in the art.

By suitable non-identical recombination site implies that in the presence of active recombinase, excision of sequences between two non-identical recombination sites occurs, if at all, with an efficiency considerably lower than the recombinationally-mediated exchange targeting arrangement of nucleotide sequences into the plant genome. Thus, suitable non-identical sites for use in the present disclosure include those sites where the efficiency of recombination between the sites is low; for example, where the efficiency is less than about 30 to about 50%, preferably less than about 10 to about 30%, more preferably less than about 5 to about 10%.

As noted above, the recombination sites in the targeting cassette correspond to those in the target site of the transformed plant. That is, if the target site of the transformed plant contains flanking non-identical recombination sites of FRT and a mutant FRT, the targeting cassette will contain the same FRT and mutant FRT non-identical recombination sites.

It is furthermore recognized that the recombinase, which is used in the disclosed methods, will depend upon the recombination sites in the target site of the transformed plant and the targeting cassette. That is, if FRT sites are utilized, the FLP recombinase will be needed. In the same manner, where lox sites are utilized, the Cre recombinase is required. If the non-identical recombination sites comprise both a FRT and a lox site, both the FLP and Cre recombinase will be required in the plant cell.

The FLP recombinase is a protein which catalyzes a site-specific reaction that is involved in amplifying the copy number of the two-micron plasmid of S. cerevisiae during DNA replication. FLP protein has been cloned and expressed. See, for example, Cox (1993) Proc. Natl. Acad. Sci. U.S.A 80: 4223-4227. The FLP recombinase for use in the present disclosure may be that derived from the genus Saccharomyces. It may be preferable to synthesize the recombinase using plant preferred codons for optimum expression in a plant of interest. See, for example, U.S. application Ser. No. 08/972,258 filed Nov. 18, 1997, entitled "Novel Nucleic Acid Sequence Encoding FLP Recombinase," herein incorporated by reference.

The bacteriophage recombinase Cre catalyzes site-specific recombination between two lox sites. The Cre recombinase is known in the art. See, for example, Guo et al. (1997) Nature 389: 40-46; Abremski et al. (1984) J. Biol.

Chem. 259: 1509-1514; Chen et al. (1996) Somat. Cell Mol. Genet. 22: 477-488; and Shaikh et al. (1977) J. Biol. Chem. 272: 5695-5702. All of which are herein incorporated by reference. Such Cre sequence may also be synthesized using plant preferred codons.

Where appropriate, the nucleotide sequences to be inserted in the plant genome may be optimized for increased expression in the transformed plant. Where mammalian, yeast, or bacterial genes are used in the present disclosure, they can be synthesized using plant preferred codons for improved expression. It is recognized that for expression in monocots, dicot genes can also be synthesized using monocot preferred codons. Methods are available in the art for synthesizing plant preferred genes. See, for example, U.S. Pat. Nos. 5,380,831, 5,436,391, and Murray et al. (1989) Nucleic Acids Res. 17: 477-498, herein incorporated by reference. The plant preferred codons may be determined from the codons utilized more frequently in the proteins expressed in the plant of interest. It is recognized that monocot or dicot preferred sequences may be constructed as well as plant preferred sequences for particular plant species. See, for example, EPA 0359472; EPA 0385962; WO 91/16432; Perlak et al. (1991) Proc. Natl. Acad. Sci. USA, 88: 3324-3328; and Murray et al. (1989) Nucleic Acids Research, 17: 477-498. U.S. Pat. Nos. 5,380,831; 5,436,391; and the like, herein incorporated by reference. It is further recognized that all or any part of the gene sequence may be optimized or synthetic. That is, fully optimized or partially optimized sequences may also be used.

Additional sequence modifications are known to enhance gene expression in a cellular host and can be used in the present disclosure. These include elimination of sequences encoding spurious polyadenylation signals, exon-intron splice site signals, transposon-like repeats, and other such well-characterized sequences, which may be deleterious to gene expression. The G-C content of the sequence may be adjusted to levels average for a given cellular host, as calculated by reference to known genes expressed in the host cell. When possible, the sequence is modified to avoid predicted hairpin secondary RNA structures.

The present disclosure also encompasses novel FLP recombination target sites (FRT). The FRT has been identified as a minimal sequence comprising two 13 base pair repeats, separated by an eight (8) base spacer. The nucleotides in the spacer region can be replaced with a combination of nucleotides, so long as the two 13-base repeats are separated by eight nucleotides. It appears that the actual nucleotide sequence of the spacer is not critical; however, for the practice of the present disclosure, some substitutions of nucleotides in the space region may work better than others. The eight-base pair spacer is involved in DNA-DNA pairing during strand exchange. The asymmetry of the region determines the direction of site alignment in the recombination event, which will subsequently lead to either inversion or excision. As indicated above, most of the spacer can be mutated without a loss of function. See, for example, Schlake and Bode (1994) Biochemistry 33: 12746-12751, herein incorporated by reference.

Novel FRT mutant sites can be used in the practice of the disclosed methods. Such mutant sites may be constructed by PCR-based mutagenesis. Although mutant FRT sites are known (see SEQ ID Nos 2, 3, 4 and 5 of WO1999/025821), it is recognized that other mutant FRT sites may be used in the practice of the present disclosure. The present disclosure is not restricted to the use of a particular FRT or recombination site, but rather that non-identical recombination sites or FRT sites can be utilized for targeted insertion and expression of nucleotide sequences in a plant genome. Thus, other mutant FRT sites can be constructed and utilized based upon the present disclosure.

As discussed above, bringing genomic DNA containing a target site with non-identical recombination sites together with a vector containing a T-DNA expression cassette with corresponding non-identical recombination sites, in the presence of the recombinase, results in recombination. The nucleotide sequence of the T-DNA expression cassette located between the flanking recombination sites is exchanged with the nucleotide sequence of the target site located between the flanking recombination sites. In this manner, nucleotide sequences of interest may be precisely incorporated into the genome of the host.

It is recognized that many variations of the present disclosure can be practiced. For example, target sites can be constructed having multiple non-identical recombination sites. Thus, multiple genes or nucleotide sequences can be stacked or ordered at precise locations in the plant genome. Likewise, once a target site has been established within the genome, additional recombination sites may be introduced by incorporating such sites within the nucleotide sequence of the T-DNA expression cassette and the transfer of the sites to the target sequence. Thus, once a target site has been established, it is possible to subsequently add sites, or alter sites through recombination.

Another variation includes providing a promoter or transcription initiation region operably linked with the target site in an organism. Preferably, the promoter will be 5' to the first recombination site. By transforming the organism with a T-DNA expression cassette comprising a coding region, expression of the coding region will occur upon integration of the T-DNA expression cassette into the target site. This aspect provides for a method to select transformed cells, particularly plant cells, by providing a selectable marker sequence as the coding sequence.

Other advantages of the present system include the ability to reduce the complexity of integration of transgenes or transferred DNA in an organism by utilizing T-DNA expression cassettes as discussed above and selecting organisms with simple integration patterns. In the same manner, preferred sites within the genome can be identified by comparing several transformation events. A preferred site within the genome includes one that does not disrupt expression of essential sequences and provides for adequate expression of the transgene sequence.

The disclosed methods also provide for means to combine multiple expression cassettes at one location within the genome. Recombination sites may be added or deleted at target sites within the genome.

Any means known in the art for bringing the three components of the system together may be used in the present disclosure. For example, a plant can be stably transformed to harbor the target site in its genome. The recombinase may be transiently expressed or provided. Alternatively, a nucleotide sequence capable of expressing the recombinase may be stably integrated into the genome of the plant. In the presence of the corresponding target site and the recombinase, the T-DNA expression cassette, flanked by corresponding non-identical recombination sites, is inserted into the transformed plant's genome.

Alternatively, the components of the system may be brought together by sexually crossing transformed plants. In this aspect, a transformed plant, parent one, containing a target site integrated in its genome can be sexually crossed with a second plant, parent two, that has been genetically transformed with a T-DNA expression cassette containing flanking non-identical recombination sites, which correspond to those in plant one. Either plant one or plant two contains within its genome a nucleotide sequence expressing recombinase. The recombinase may be under the control of a constitutive or inducible promoter. In this manner, expression of recombinase and subsequent activity at the recombination sites can be controlled.

The disclosed methods are useful in targeting the integration of transferred nucleotide sequences to a specific chromosomal site. The nucleotide sequence may encode any nucleotide sequence of interest. Particular genes of interest include those which provide a readily analyzable functional feature to the host cell and/or organism, such as marker genes, as well as other genes that alter the phenotype of the recipient cells, and the like. Thus, genes effecting plant growth, height, susceptibility to disease, insects, nutritional value, and the like may be utilized in the present disclosure. The nucleotide sequence also may encode an 'antisense' sequence to turn off or modify gene expression.

It is recognized that the nucleotide sequences will be utilized in a functional expression unit or T-DNA expression cassette. By functional expression unit or T-DNA expression cassette is intended, the nucleotide sequence of interest with a functional promoter, and in most instances a termination region. There are various ways to achieve the functional expression unit within the practice of the present disclosure. In one aspect of the present disclosure, the nucleic acid of interest is transferred or inserted into the genome as a functional expression unit.

Alternatively, the nucleotide sequence may be inserted into a site within the genome which is 3' to a promoter region. In this latter instance, the insertion of the coding sequence 3' to the promoter region is such that a functional expression unit is achieved upon integration. The T-DNA expression cassette will comprise a transcriptional initiation region, or promoter, operably linked to the nucleic acid encoding the peptide of interest. Such an expression cassette is provided with a plurality of restriction sites for insertion of the gene or genes of interest to be under the transcriptional regulation of the regulatory regions.

Methods of characterizing plant cells including, but not limited to, genotyping DNA isolated from a plant cell, measuring RNA transcripts isolated from a plant cell, measuring nucleosome abundance or densities of chromatin isolated from a plant cell, measuring post-translational modifications of histone proteins of chromatin isolated from a plant cell, measuring epigenetic modifications of DNA or RNA isolated from a plant cell, measuring protein:DNA interactions of chromatin isolated from a plant cell, and measuring protein:RNA interactions or complexes isolated from a plant cell are useful in the methods of the present disclosure.

The characterization information and data from plants cells generated in the methods of the present disclosure is used to predict phenotypic performance the plant cells and facilitate breeding decisions earlier in the development process. Methods of predicting phenotypic performance of plant cells including, but not limited to, using genomic data based on genotyping by DNA sequencing of a plant cell, using genomic data based on genotyping by assay of a plant cell, using genomic data based on a known or predicted expression state of a plant cell, using genomic data based on a known or predicted chromatin state of a plant cell, using genomic data based on a known or predicted epigenetic regulatory state of a plant cell, and using genotype imputation of shared haplotype genomic data of a plant cell and/or pedigree history data of a plant cell are useful in the methods of the present disclosure and facilitate the plant breeding process.

Methods of characterizing plant cells and predicting phenotypic performance are known in the art and are disclosed in U.S. Pat. Nos. 6,399,855, 8,039,686, 8,321,147, U.S. Ser. No. 10/031,116, U.S. Ser. No. 10/102,476, US20160321396, US20170245446, US20170359978, and US20180363069 all of which are incorporated herein by reference in their entireties.

EXPERIMENTAL

Example 1: Plasmids

See Table 9 for a description of the plasmids comprising the indicated components referenced in the Examples. Plasmid IDs followed by a "+" comprise T-DNA containing the indicated components and additional indicated components located beyond the T-DNA Left Border (LB). As is within the skill in the art, the additional components may alternatively be located beyond the T-DNA Right Border (RB).

TABLE 9

| SEQ ID NO: | Plasmid ID | Plasmid Components |
|---|---|---|
| 181 | PHP87078 | RB + FMV ENH:PSCV ENH:MMV ENH:ZM-PLTP PRO::ZM-WUS2::IN2-1 TERM + SB-UBI PRO::ZS-GREEN1::OS-UBI TERM + LB |
| 182 | PHP88158 | RB + FMV ENH:PSCV ENH:MMV ENH:ZM-PLTP PRO::ZM-WUS2::IN2-1 TERM + NOS PRO::CRC::SB-GKAF TERM + LB |
| 183 | PHP86491 | RB + SB-UBI PRO::ZS-GREEN1::OS-UBI TERM + SB-ALS PRO::ZM-HRA::PINII TERM + LB |
| 184 | PHP71539 | pVIR9 |
| 185 | RV038288 | RB + FMV ENH:PSCV ENH:MMV ENH:ZM-3XEME-ZM-PME10 PRO::ZM-WUS2::IN2-1 TERM + NOS PRO::CRC:SB-GKAF TERM (MOD1) + LB |
| 186 | RV020636 | RB + FMV ENH:PSCV ENH:MMV ENH:ZM-PLTP PRO:3XEME::ZM-WUS2::IN2-1 TERM + NOS PRO::CRC:SB-GKAF TERM (MOD1) + LB |
| 187 | RV022819 | RB + FMV ENH:PSCV ENH:MMV ENH:ZM-PLTP PRO::ZM-WUS2:GALLS$^{C27}$::IN2-1 TERM + NOS PRO::CRC:SB-GKAF TERM (MOD1) + LB |
| 188 | RV022820 | RB + FMV ENH:PSCV ENH:MMV ENH:ZM-PLTP PRO::ZM-WUS2:virF$^{C127}$::IN2-1 TERM + NOS PRO::CRC:SB-GKAF TERM (MOD1) + LB |

TABLE 9-continued

| SEQ ID NO: | Plasmid ID | Plasmid Components |
|---|---|---|
| 189 | RV006010 | RB + UBIZM PRO::CAS9(SP) (MO) + ZM-U6 POLIII::crRNA-tracRNA fusion transcript + RAB17 PRO::MO-CRE + UBIZM PRO::NPTII + CAMV35S ENH::LTP2 PRO::AM-CYAN + LB |
| 190 | PHP91522 | LB + ZmUbi1 3' UTR::IPK1 eZFN 12::ZmUbi1 promoter + ZmGlob1::IPK1 eZFN Target Sequence::IPK1 Left Homology Arm::DSM2::IPK1 Right Homology Arm::IPK1 eZFN Target Sequence::Zm B-Peru::AtuNOS 3'UTR + RB |
| 191 | PHP90308 | LB + ZmUbi1 3' UTR:: Event 32 eZFN 12::ZmUbi1 promoter + ZmGlob1:: Event 32 eZFN Target Sequence:: Event 32 Left Homology Arm::DSM2:: Event 32 Right Homology Arm:: Event 32 eZFN Target Sequence::Zm B-Peru::AtuNOS 3'UTR + RB |
| 192 | PHP90670 | RB + ZM-UBI TERM::6FRAME STOPS1::FOKI-V33::EXZFN10618.2:ZM-OP2 NLS-V1:T2A:FOKI-V33:ZM-OP2 NLS-V1:UBI1ZM INTRON1:UBI1ZM 5UTR (PHI)::UBI1ZM PRO-V3 + ZM-GLB PRO::ZM-C1-V3::6FRAME STOPS2::NOS TERM + ZM-GLB PRO::AGTRT34308.1::AGTRT34309.1::UBI1ZM PRO-V12::UBI1ZM 5UTR (PHI)::UBI1ZM INTRON1-V4::DHTGE970.17::6FRAME STOPS1_ZM-LIP404.1::TERM::AGTRT34311.1::AGTRT34308.1::ZM-BP-V2_6FRAME STOPS1::NOS TERM + LB |
| 193 | RV025340 | RB + UBI PRO::CFP::PINII TERM + 3XENH::ZM-PLTP PRO::ZM-ODP2::IN2-1 TERM + LB |
| 194 | PHP91539 | RB + 3XENH::ZM-PLTP PRO::ZM-WUS2::IN2-1 TERM + ZM-PLTP1 PRO::ZM-ODP2::OS-T28 TERM + NOS PRO::CRC::SB-GKAF TERM + LB |
| 317 | RV036376 | RB + UBIZM PRO::CAS9(SP) (MO) + ZM-U6 POLIII::crRNA-tracRNA fusion transcript + RAB17 PRO::MO-CRE + ZM-PLTP PRO::ZM-PLTP 5 UTR: ZM-ODP2 (ALT1):OS-T28 TERM + UBIZM PRO::NPTII + LB |
| 344 | PHV00002 | FRT1 + NPTII::PINII TERM + UBI1ZM PRO::UBI1ZM INTRON1::ZS-GREEN1::PINII TERM + FRT6 |
| 345 | PHV00003 | RB + UBI1ZM PRO::UBI1ZM INTRON1::FLPM-EXON1::ST-LS1 INTRON2-V2::FLPM-EXON2::PINII + FRT1 + NPTII::PINII TERM + UBI1ZM PRO::UBI1ZM INTRON1::DS-RED2 (ALT1)::PINII TERM + FRT6 + LB |
| 346 | PHV00004 | ZM1UBI PRO::FLPm::PINII TERM |
| 347 | PHV00005 | 3XENH::PLTP PRO::WUS2::IN2-1 TERM |
| 348 | PHV00007 | RB + LOXP + AXIG1::WUS2::IN2-1 TERM + PLTP::ODP2::PINII TERM::CZ19B1 TERM + ZM1UBI PRO:: ZM1UBI 5UTR:: ZM1UBI INTRON1::NLS::CAS9 EXON1::ST-LS1 INTRON2::CAS9 EXON2::VIRD2 NLS::PINII TERM + ZM-U6 POLIII CHR8 PRO::ZM-CHR1-52.56-8CR1::GUIDE RNA::ZM-U6 POLIII CHR8 TERM + ZM-HSP18A PRO::MO-CRE EXON1:: ST-LS1 INTRON2::MO-CRE EXON2::PINII TERM + HR1 + LOXP + ZM1UBI PRO::FRT1::NPTII::PINII TERM + FRT6 + HR2 + LB |
| 349 | PHV00008 | HR1 + LOXP + ZM1UBI PRO::ZM1UBI 5UTR:: ZM1UBI INTRON1:: FRT1::NPTII::PINII TERM + FRT6 + HR2 |
| 352 | PHV00009 | ZM1UBI PRO:: ZM1UBI 5UTR:: ZM1UBI INTRON1::NLS::CAS9 EXON1::ST-LS1 INTRON2::CAS9 EXON2::VIRD2 NLS::PINII TERM |
| 353 | PHV00010 | ZM-U6 POLIII CHR8 PRO::ZM-CHR1-52.56-8CR1::GUIDE RNA::ZM-U6 POLIII CHR8 TERM |

Example 2: Culture Media

See Tables 10-15 for a description of the media formations for transformation, selection and regeneration referenced in the Examples.

TABLE 10

| Medium components | Units per liter | 12R | 810K | 700A | 710I | 605J | 605T | 562V | 289Q |
|---|---|---|---|---|---|---|---|---|---|
| MS BASAL SALT MIXTURE | g | | | 4.3 | 4.3 | 4.3 | 4.3 | | 4.3 |

TABLE 10-continued

| Medium components | Units per liter | 12R | 810K | 700A | 710I | 605J | 605T | 562V | 289Q |
|---|---|---|---|---|---|---|---|---|---|
| N6 BASAL SALTS | g | | | | | | | 4.0 | |
| N6 MACRONUTRIENTS 10X | ml | | | | | 60.0 | 60.0 | | |
| POTASSIUM NITRATE | g | | | | | 1.7 | 1.7 | | |
| B5H MINOR SALTS 1000X | ml | | | | | 0.6 | 0.6 | | |
| NaFe EDTA FOR B5H 100X | ml | | | | | 6.0 | 6.0 | | |
| ERIKSSON'S VITAMINS 1000X | ml | | | | | 0.4 | 0.4 | 1.0 | |
| S&H VITAMIN STOCK 100X | ml | | | | | 6.0 | 6.0 | | |
| THIAMINE•HCL | mg | | | 10.0 | 10.0 | 0.5 | 0.5 | 0.5 | |
| L-PROLINE | g | | | | 0.7 | 2.0 | 2.0 | 0.69 | 0.7 |
| CASEIN HYDROLYSATE (ACID) | g | | | | | 0.3 | 0.3 | | |
| SUCROSE | g | | | 68.5 | 20.0 | 20.0 | 20.0 | 30.0 | 60.0 |
| GLUCOSE | g | 5.0 | | 36.0 | 10.0 | 0.6 | 0.6 | | |
| MALTOSE | g | | | | | | | | |
| 2,4-D | mg | | | 1.5 | 2.0 | 0.8 | 0.8 | 2.0 | |
| AGAR | g | 15.0 | | | 8.0 | 6.0 | 6.0 | 8.0 | 8.0 |
| BACTO-AGAR | g | | 15.0 | | | | | | |
| PHYTAGEL | g | | | | | | | | |
| DICAMBA | g | | | | | 1.2 | 1.2 | | |
| SILVER NITRATE | mg | | | | | 3.4 | 3.4 | 0.85 | |
| AGRIBIO Carbenicillin | mg | | | | | 100.0 | | | |
| Timentin | mg | | | | | | 150.0 | | 150.0 |
| Cefotaxime | mg | | | | | | 100.0 | | 100.0 |
| MYO-INOSITOL | g | | | 0.1 | 0.1 | | | | 0.1 |
| NICOTINIC ACID | mg | | | 0.5 | 0.5 | | | | |
| PYRIDOXINE•HCL | mg | | | 0.5 | 0.5 | | | | |
| VITAMIN ASSAY CASAMINO ACIDS | g | | | 1.0 | | | | | |
| MES BUFFER | g | | | | 0.5 | | | | |
| ACETOSYRINGONE | uM | | | | 100.0 | | 100.0 | | |
| ASCORBIC ACID 10 MG/ML (7S) | mg | | | | 10.0 | | | | |
| MS VITAMIN STOCK SOL. | ml | | | | | | | | 5.0 |
| ZEATIN | mg | | | | | | | | 0.5 |
| CUPRIC SULFATE | mg | | | | | | | | 1.3 |
| IAA 0.5 MG/ML (28A) | ml | | | | | | | | 2.0 |
| ABA 0.1 mm | ml | | | | | | | | 1.0 |
| THIDIAZURON | mg | | | | | | | | 0.1 |
| AGRIBIO Carbenicillin | mg | | | | | | | | 100.0 |
| PPT(GLUFOSINATE-NH4) | mg | | | | | | | | |
| BAP | mg | | | | | | | | 1.0 |
| YEAST EXTRACT (BD Difco) | g | | 5.0 | | | | | | |
| PEPTONE | g | | 10.0 | | | | | | |
| SODIUM CHLORIDE | g | | 5.0 | | | | | | |
| SPECTINOMYCIN | mg | 50.0 | 50.0 | | | | | | |
| FERROUS SULFATE•7H20 | ml | 2.0 | | | | | | | |
| AB BUFFER 20X (12D) | ml | 50.0 | | | | | | | |
| AB SALTS 20X (12E) | ml | 50.0 | | | | | | | |
| THYMIDINE | mg | 50.0 | 50.0 | 50.0 | | | | 50.0 | |
| GENTAMYCIN | mg | 50.0 | 50.0 | | | | | | |
| Benomyl | mg | | | | | | | | |
| pH | | | 6.8 | 5.2 | 5.8 | 5.8 | 5.8 | 5.8 | 5.6 |

TABLE 11

| Medium components | Units per liter | 20A | 70A | 70B | 70C |
|---|---|---|---|---|---|
| MS BASAL SALT MIXTURE | g | 4.3 | 4.3 | 4.3 | 4.3 |
| THIAMINE•HCL | mg | 0.12 | 0.12 | 0.12 | 0.12 |
| SUCROSE | g | | 20 | 20 | 20 |
| PVP40 | g | | 0.5 | 0.5 | 0.5 |
| TC AGAR | g | | 5 | 5 | 5 |
| SILVER NITRATE | mg | | 2.0 | 2.0 | 2.0 |
| AGRIBIO Carbenicillin | g | | 0.5 | 0.5 | 0.5 |
| Adenine Hemisulfate Salt | mg | | 40 | 40 | 40 |
| MYO-INOSITOL | g | 0.1 | 0.1 | 0.1 | 0.1 |
| NICOTINIC ACID | mg | 0.57 | 0.57 | 0.57 | 0.57 |
| PYRIDOXINE•HCL | mg | 0.57 | 0.57 | 0.57 | 0.57 |
| Glycine | mg | 2.3 | 2.3 | 2.3 | 2.3 |
| MES BUFFER | g | 0.5 | 0.5 | 0.5 | 0.5 |
| ACETO SYRINGONE | uM | 200 | | | |
| NAA | mg | 0.1 | 0.1 | 0.1 | 0.1 |
| BAP | mg | 1.0 | 1.0 | 1.0 | 1.0 |
| Gibberellic Acid | ug | 10 | 10 | 10 | 10 |
| SPECTINOMYCIN | mg | | 5 | 10 | 10 |
| pH | | 5.5 | 5.7 | 5.7 | 5.7 |

The compositions of various media used in soybean transformation, tissue culture and regeneration are outlined in Table 12. In this table, medium M1 is used for initiation of suspension cultures, if this is the starting material for transformation. Media M2 and M3 represent typical co-cultivation media useful for *Agrobacterium* transformation of the entire range of explants listed above. Medium M4 is useful for selection (with the appropriate selective agent), M5 is used for somatic embryo maturation, and medium M6 is used for germination to produce T0 plantlets.

TABLE 12

| | M1 | M2 | M3 | M4 | M5 | M6 |
|---|---|---|---|---|---|---|
| MS salt with B5 vitamins (PhytoTech M404) | 4.44 g/L | | | 4.4 g/L | 4.44 g/L | |
| Gamborg B-5 basal medium (PhytoTech G398) | | | | | | 3.21 g/L |
| Modified MS salt (PhytoTech M571) | | 2.68 g/L | 2.68 g/L | | | |
| B5 vitamins (1000X) (PhytoTech G249) | | 1 ml | 1 ml | 1 ml | | |
| 2,4-D stock 10 mg/ml | 4 ml | 1 ml | 1 ml | 4 ml | | |
| KNO$_3$ | | 1.64 g/L | 1.64 g/L | | | |
| (NH$_4$)$_2$SO$_4$ | | 0.463 g/L | 0.463 g/L | | | |
| Asparagine | | 1 g/L | 1 g/L | | | |
| Sucrose | | 68.5 g/L | 85.6 g/L | | | 20 g/L |
| Glucose | 31.5 g/L | 36 g/L | 49.6 g/L | 31.5 g/l | | |
| Maltose | | | | | 60 g/L | |
| MgCl$_2$.6H$_2$O | | | | | 0.75 g/L | |
| Activated charcoal (PhytoTech C325) | | | | | 5 g/L | |
| Casein hydrolysate (PhytoTech C184) | | 1 g/L | 1 g/L | | | |
| pH | 7.0 | 5.4 | 5.4 | 7.0 | 5.7 | 5.7 |
| Acetosyringone | | 300 μM | 300 μM | | | |
| TC agar | 4 g/L | | | | | 5 g/L |
| Gelrite (Plant Media Cat# 714246) | | | | | 2 g/l | 2 g/L |

TABLE 13

Media used for sorghum transformation.
Medium Composition

PHI-I: 4.3 g/l MS salts (Phytotechnology Laboratories, Shawnee Mission, KS, catalog number M524), 0.5 mg/l nicotinic acid, 0.5 mg/l pyridoxine HCl, 1 mg/l thiamine HCl, 0.1 g/l myo-inositol, 1 g/l casamino acids (Becton Dickinson and Company, B D

TABLE 13-continued

Media used for sorghum transformation.
Medium Composition

Diagnostic Systems, Sparks, MD, catalog number 223050), 1.5 mg/l 2,4-dichlorophenoxyacetic acid (2,4-D), 68.5 g/l sucrose, 36 g/l glucose, pH 5.2; with 100 μM acetosyringone added before using.
PHI-T: PHI-I with 20 g/l sucrose, 10 g/l glucose, 2 mg/l 2,4-D, no casamino acids, 0.5 g/l MES buffer, 0.7 g/l L-proline, 10 mg/l ascorbic acid, 100 μM acetosyringone, 8 g/l agar, pH 5.8.
PHI-U: PHI-T with 1.5 mg/l 2,4-D 100 mg/l carbenicillin, 30 g/l sucrose, no glucose and acetosyringone; 5 mg/l PPT, pH 5.8.
PHI-UM: PHI-U with 12.5 g/l mannose and 5 g/l maltose, no sucrose, no PPT, pH 5.8
PHI-V: PHI-U with 10 mg/l PPT
DBC3: 4.3 g/l MS salts, 0.25 g/l myo-inositol, 1.0 g/l casein hydrolysate, 1.0 mg/l thiamine HCL, 1.0 mg/l 2,4-D, 30 g/l maltose, 0.69 g/l L-proline, 1.22 mg/l cupric sulfate, 0.5 mg/l BAP, 3.5 g/l phytagel, pH 5.8
PHI-X: 4.3 g/l MS salts, 0.1 g/l myo-inositol, 5.0 ml MS vitamins stock[b], 0.5 mg/l zeatin, 700 mg/l L-proline, 60 g/l sucrose, 1 mg/l indole-3-acetic acid, 0.1 μM abscisic acid, 0.1 mg/l thidiazuron, 100 mg/l carbenicillin, 5 mg/l PPT, 8 g/l agar, pH 5.6.
PHI-XM: PHI-X with no PPT; added 1.25 mg/l cupric sulfate, pH 5.6.
PHI-Z: 2.15 g/l MS salts, 0.05 g/l myo-inositol, 2.5 ml MS vitamins stock[b], 20 g/l sucrose, 3 g/l phytagel, pH 5.6

[a]PHI-I, PHI-T, PHI-U, PHI-V, PHI-X, and PHI-Z media from Zhao et al. 2000
[b]MS vitamins stock: 0.1 g/l nicotinic acid, 0.1 g/l pyridoxine HCl, 0.02 g/l thiamine HCl, 0.4 g/l glycine.

TABLE 14

Media used for wheat transformation.

| Ingredient | 716B Quantity | 606 Quantity | 689E Quantity |
|---|---|---|---|
| D-I WATER, POLISHED | 950 ml | 950 ml | 950 ml |
| MS BASAL SALT MIXTURE | 4.3 g | 4.3 g | 4.3 g |
| CHU(N6) BASAL SALTS | | 2.39 g | |
| POTASSIUM NITRATE | | 1.68 g | |
| B5H MINOR SALTS 1000X | | 0.6 ml | |
| NaFe EDTA FOR B5H 100X | | 6 ml | |
| ERIKSSON'S VITAMINS 1000X | | 0.4 ml | |
| S&H VITAMIN STOCK 100X | | 6 ml | |
| L-PROLINE | | 1.98 g | |
| CASEIN HYDROLYSATE (ACID) | | 0.3 g | |
| MALTOSE | | 30 g | |
| GLUCOSE | | 10 g | |
| MYO-INOSITOL | 0.1 g | | 1.1 g |
| MS VITAMIN STOCK SOLN* | 5 ml | | 5 ml |
| 2,4-D 0.5 mg/ml | 1 ml | 1.6 ml | |
| CUPRIC SULFATE 1 MG/ML | | 1.22 ml | |
| BAP 1 MG/ML | | 0.5 ml | |
| Picloram 10 mg/ml | 0.2 ml | | |
| MALTOSE | 30 g | | |
| MES BUFFER | 1.95 g | | |
| CUPRIC SULFATE 1 MG/ML | 1.22 ml | | |
| BAP 1 MG/ML | 0.5 ml | | |
| TC-AGAR | | | 6 g |
| PHYTAGEL | 2.5 g | 3.5 g | 3.5 g |
| pH | 5.8 | 5.8 | 5.8 |
| ACETOSYRINGONE 100 mM | 4 ml | | |
| thymidine (50 mg/ml) | 1 ml | 0.5 ml | |
| Dicamba (1 mg/ml) | | 1.2 ml | |
| Cefotaxime (250 mg/ml) | | 0.4 ml | 0.4 ml |
| sucrose | | | 60 g |
| phosphinothricin (1 mg/ml) | | | 5 ml |

*MS Vitamin Stock: 0.1 g/l nicotinic acid, 0.02 g/l thiamine, 0.1 g/l pyridoxine, 0.4 g/l glycine

TABLE 15

Media used for maize transformation.

| Medium components | Units per liter | 12V | 810I | 700 | 710I | 605J | 605T | 289Q |
|---|---|---|---|---|---|---|---|---|
| MS BASAL SALT MIXTURE | g | | | 4.3 | 4.3 | 4.3 | 4.3 | 4.3 |
| N6 MACRONUTRIENTS 10X | ml | | | | | 60.0 | 60.0 | |
| POTASSIUM NITRATE | g | | | | | 1.7 | 1.7 | |
| B5H MINOR SALTS 1000X | ml | | | | | 0.6 | 0.6 | |
| NaFe EDTA FOR B5H 100X | ml | | | | | 6.0 | 6.0 | |
| ERIKSSON'S VITAMINS 1000X | ml | | | | | 0.4 | 0.4 | |
| S&H VITAMIN STOCK 100X | ml | | | | | 6.0 | 6.0 | |
| THIAMINE•HCL | mg | | | 10.0 | 10.0 | 0.5 | 0.5 | |
| L-PROLINE | g | | | | 0.7 | 2.0 | 2.0 | 0.7 |
| CASEIN HYDROLYSATE (ACID) | g | | | | | 0.3 | 0.3 | |
| SUCROSE | g | | | 68.5 | 20.0 | 20.0 | 20.0 | 60.0 |
| GLUCOSE | g | 5.0 | | 36.0 | 10.0 | 0.6 | 0.6 | |
| MALTOSE | g | | | | | | | |
| 2,4-D | mg | | | 1.5 | 2.0 | 0.8 | 0.8 | |
| AGAR | g | 15.0 | 15.0 | | 8.0 | 6.0 | 6.0 | 8.0 |

TABLE 15-continued

Media used for maize transformation.

| Medium components | Units per liter | | | | | |
|---|---|---|---|---|---|---|
| PHYTAGEL | g | | | | 1.2 | 1.2 |
| DICAMBA | g | | | | | |
| SILVER NITRATE | mg | | | | 3.4 | 3.4 |
| AGRIBIO Carbenicillin | mg | | | | 100.0 | |
| Timentin | mg | | | | | 150.0 | 150.0 |
| Cefotaxime | mg | | | | | 100.0 | 100.0 |
| MYO-INOSITOL | g | | 0.1 | 0.1 | | | 0.1 |
| NICOTINIC ACID | mg | | 0.5 | 0.5 | | | |
| PYRIDOXINE•HCL | mg | | 0.5 | 0.5 | | | |
| VITAMIN ASSAY CAS AMINO ACIDS | g | | 1.0 | | | | |
| MES BUFFER | g | | | 0.5 | | | |
| ACETOSYRINGONE | uM | | | 100.0 | | | |
| ASCORBIC ACID 10 MG/ML (7S) | mg | | | 10.0 | | | |
| MS VITAMIN STOCK SOL. | ml | | | | | | 5.0 |
| ZEATIN | mg | | | | | | 0.5 |
| CUPRIC SULFATE | mg | | | | | | 1.3 |
| IAA 0.5 MG/ML (28A) | ml | | | | | | 2.0 |
| ABA 0.1 mm | ml | | | | | | 1.0 |
| THIDIAZURON | mg | | | | | | 0.1 |
| AGRIBIO Carbenicillin | mg | | | | | | 100.0 |
| PPT(GLUFOSINATE-NH4) | mg | | | | | | |
| BAP | mg | | | | | | 1.0 |
| YEAST EXTRACT (BD Difco) | g | 5.0 | | | | | |
| PEPTONE | g | 10.0 | | | | | |
| SODIUM CHLORIDE | g | 5.0 | | | | | |
| SPECTINOMYCIN | mg | 50.0 | 100.0 | | | | |
| FERROUS SULFATE•7H2O | ml | 2.0 | | | | | |
| AB BUFFER 20X (12D) | ml | 50.0 | | | | | |
| AB SALTS 20X (12E) | ml | 50.0 | | | | | |
| Benomyl | mg | | | | | | |
| pH | | | | | | | 5.6 |

| Medium components | Units per liter | 289R | 13158H | 13224B | 13266K | 272X | 272V | 13158 |
|---|---|---|---|---|---|---|---|---|
| MS BASAL SALT MIXTURE | g | 4.3 | 4.3 | | 4.3 | 4.3 | 4.3 | 4.3 |
| N6 MACRONUTRIENTS 10X | ml | | | 4.0 | 60.0 | | | |
| POTASSIUM NITRATE | g | | | | 1.7 | | | |
| B5H MINOR SALTS 1000X | ml | | | | 0.6 | | | |
| NaFe EDTA FOR B5H 100X | ml | | | | 6.0 | | | |
| ERIKSSON'S VITAMINS 1000X | ml | | | 1.0 | 0.4 | | | |
| S&H VITAMIN STOCK 100X | ml | | | | 6.0 | | | |
| THIAMINE•HCL | mg | | | 0.5 | 0.5 | | | |
| L-PROLINE | g | 0.7 | 0.7 | 2.9 | 2.0 | | | |
| CASEIN HYDROLYSATE (ACID) | g | | | | 0.3 | | | |
| SUCROSE | g | 60.0 | 60.0 | 190.0 | 20.0 | 40.0 | 40.0 | 40.0 |
| GLUCOSE | g | | | | 0.6 | | | |
| MALTOSE | g | | | | | | | |
| 2,4-D | mg | | | | 1.6 | | | |
| AGAR | g | | 8.0 | 6.4 | 6.0 | 6.0 | 6.0 | 6.0 |
| PHYTAGEL | g | | | | | | | |
| DICAMBA | g | | | | 1.2 | | | |
| SILVER NITRATE | mg | | | 8.5 | 1.7 | | | |
| AGRIBIO Carbemcillin | mg | | | | 2.0 | | | |
| Timentin | mg | 150.0 | 150.0 | | | | | |
| Cefotaxime | mg | 100.0 | 100.0 | 25 | 25 | | | |
| MYO-INOSITOL | g | 0.1 | 0.1 | | | 0.1 | 0.1 | 0.1 |
| NICOTINIC ACID | mg | | | | | | | |
| PYRIDOXINE•HCL | mg | | | | | | | |
| VITAMIN ASSAY CAS AMINO ACIDS | g | | | | | | | |
| MES BUFFER | g | | | | | | | |
| ACETOSYRINGONE | uM | | | | | | | |
| ASCORBIC ACID 10 MG/ML (7S) | mg | | | | | | | |
| MS VITAMIN STOCK SOL. | ml | 5.0 | 5.0 | | | 5.0 | 5.0 | 5.0 |
| ZEATIN | mg | 0.5 | 0.5 | | | | | |
| CUPRIC SULFATE | mg | 1.3 | 1.3 | | | | | |
| IAA 0.5 MG/ML (28A) | ml | 2.0 | 2.0 | | | | | |
| ABA 0.1 mm | ml | 1.0 | 1.0 | | | | | |
| THIDIAZURON | mg | 0.1 | 0.1 | | | | | |
| AGRIBIO Carbemcillin | mg | | | | | | | |

TABLE 15-continued

Media used for maize transformation.

| | | | |
|---|---|---|---|
| PPT(GLUFOSINATE-NH4) | mg | | |
| BAP | mg | | |
| YEAST EXTRACT (BD Difco) | g | | |
| PEPTONE | g | | |
| SODIUM CHLORIDE | g | | |
| SPECTINOMYCIN | mg | | |
| FERROUS SULFATE•7H20 | ml | | |
| AB BUFFER 20X (12D) | ml | | |
| AB SALTS 20X (12E) | ml | | |
| Benomyl | mg | | 100.0 |
| pH | | 0.5 | 5.6 |

Example 3: *Agrobacterium*-Mediated Transformation of Corn

A. Preparation of *Agrobacterium* Master Plate.

*Agrobacterium tumefaciens* harboring a binary donor vector was streaked out from a −80° C. frozen aliquot onto solid 12R medium and cultured at 28° C. in the dark for 2-3 days to make a master plate.

B. Growing *Agrobacterium* on Solid Medium.

A single colony or multiple colonies of *Agrobacterium* were picked from the master plate and streaked onto a second plate containing 810K medium and incubated at 28° C. in the dark overnight.

*Agrobacterium* infection medium (700 A; 5 ml) and 100 mM 3'-5'-Dimethoxy-4'-hydroxyacetophenone (acetosyringone; 5 µL) were added to a 14 mL conical tube in a hood. About 3 full loops of *Agrobacterium* from the second plate were suspended in the tube and the tube was then vortexed to make an even suspension. The suspension (1 ml) was transferred to a spectrophotometer tube and the optical density (550 nm) of the suspension was adjusted to a reading of about 0.35-1.0. The *Agrobacterium* concentration was approximately 0.5 to 2.0×10$^9$ cfu/mL. The final *Agrobacterium* suspension was aliquoted into 2 mL microcentrifuge tubes, each containing about 1 mL of the suspension. The suspensions were then used as soon as possible.

C. Growing *Agrobacterium* on Liquid Medium.

Alternatively, *Agrobacterium* can be prepared for transformation by growing in liquid medium. One day before infection, a 125 ml flask was prepared with 30 ml of 557 A medium (10.5 g/l potassium phosphate dibasic, 4.5 g/l potassium phosphate monobasic anhydrous, 1 g/l ammonium sulfate, 0.5 g/l sodium citrate dehydrate, 10 g/l sucrose, 1 mM magnesium sulfate) and 30 µL spectinomycin (50 mg/mL) and 30 µL acetosyringone (20 mg/mL). A half loopful of *Agrobacterium* from a second plate was suspended into the flasks and placed on an orbital shaker set at 200 rpm and incubated at 28° C. overnight. The *Agrobacterium* culture was centrifuged at 5000 rpm for 10 min. The supernatant was removed and the *Agrobacterium* infection medium (700 A) with acetosyringone solution was added. The bacteria were resuspended by vortex and the optical density (550 nm) of the *Agrobacterium* suspension was adjusted to a reading of about 0.35 to 2.0.

D. Maize Transformation.

Ears of a maize (*Zea mays* L.) cultivar were surface-sterilized for 15-20 min in 20% (v/v) bleach (5.25% sodium hypochlorite) plus 1 drop of Tween 20 followed by 3 washes in sterile water. Immature embryos (IEs) were isolated from ears and were placed in 2 ml of the *Agrobacterium* infection medium (700 A) with acetosyringone solution. The optimal size of the embryos varies based on the inbred, but for transformation with WUS2 and ODP2 a wide size range of immature embryo sizes could be used. After collecting all embryos, the 700 A medium was removed and 1 mL of the *Agrobacterium* suspension was added to the embryos, the tube was vortexed for 5-10 seconds and incubated for approximately 5 minutes under sterile conditions. The treated embryos were then transferred on 562V (or 710I) co-cultivation medium (see Example 2) and the excess liquid was manually removed using a 1.0 mL pipet tip. Each embryo was placed flat side down. Each plate was incubated at 21° C. under dark conditions 1-3 days of co-cultivation. After 24 hours the treated embryos were transferred to resting medium (605J medium) without selection.

E. Chromosome Doubling

Preferentially, treated haploid embryos can be transferred to resting medium (605J medium) with a chromosome doubling (or mitotic inhibitor) agent, for example colchicine concentrations of 0.1-1.0 g/ml to cause mitotic arrest of dividing cells at metaphase by interfering with microtubule organization, for example for a 24-hour period before transfer to a resting medium (605J medium, or preferentially 605T medium) without a chromosome doubling agent followed by incubation at 28° C. under dark conditions. Three to 7 days later, the embryos were transferred to maturation medium (289Q medium) without selection.

Example 4: Obtaining a Genetically Diverse Population of Maize Haploid Embryos Seed from an F1 hybrid maize plant resulting from cross fertilization of two genetically different inbred parental strains were planted and the F1 hybrid plants were used as female parent plants (pollen receivers). Genetic diversity is created per ovule, with each ovule being a unique genetic entity due to meiotic recombination during megagametogenesis. Seeds from haploid inducer lines, such as Stock 6, RWS, KEMS, KMS, ZMS, or related derivatives were planted, and the resulting plants were used as male parent plants (pollen donors). The ears of the female parent plants were shoot-bagged before silk emergence. The silks of the ears on the plants of the female parent plants were pollinated with viable pollen grains collected from the anthers of the male parent plants (haploid inducer plants). This pollination was controlled by the method used regularly in maize breeding programs to avoid any foreign pollen contamination.

This results in the production of about 2-30% of all embryos being haploid embryos per ear, with frequencies known to differ per choice of the haploid inducer line used. At approximately 9-14 days after pollination, immature ears were harvested. The ears were surface sterilized in 30% Clorox bleach plus 0.5% Micro detergent for 20 minutes, and rinsed two times with sterile water, and then are used to isolate immature embryos from each ear.

The haploid embryos were isolated based on the identification of a visible marker gene in the inducer lines. For example, if the inducer line was a stable transformed line with a fluorescent reporter gene and/or has inherited an anthocyanin reporter gene, for example the R1-scm gene (see U.S. Pat. No. 8,859,846 incorporated herein by reference in its entirety), then gene regulation by a promoter allowing the fluorescent protein and/or anthocyanin synthesis in the embryos at an early developmental stage allows ploidy determination. For transgenic methods, typical promoters that are useful include the maize oleosin promoter or the *Zea mays* Ubiquitin promoter. After paternal genome elimination, the maternal haploid embryos have only one set of chromosomes from the female parent in the embryo cells and these haploid embryos will test negative for the presence of the visible marker gene. By using this kind of visible marker, haploid embryos were identified as those without the fluorescent reporter gene and/or R1-scm expression and selected from diploid embryos expressing a fluorescent protein or anthocyanin pigmentation.

Here, a haploid inducer with a R1-scm allele stably transformed with an expression cassette encoding a ZsYELLOW fluorescent protein operably linked to the *Zea mays* UBIQUITIN promoter (ZmUBIpro) was used as the pollen donor and typically resulted in approximately 25% of the immature embryos being haploid embryos. These haploid embryos were used in the experiments described herein.

Example 5: Activating Clonal Propagation in Maize Haploid Embryos

The following experiments demonstrated that delivery of a plasmid containing WUS2 improved clonal propagation of wild type, non-transformed doubled haploids. In addition, the following experiments demonstrated that both the regulatory sequence controlling the morphogenic gene cassette as well as variation of the morphogenic protein per se affected frequencies for regenerating either transgenic or non-transgenic plants.

Immature embryos of a maize F1 hybrid were crossed with a haploid inducer as described in Example 4 were transformed with *Agrobacterium* strain LBA4404 THY— (See U.S. Pat. No. 8,334,429 incorporated herein by reference in its entirety) as described in Example 3 containing T-DNAs as described in Table 9. Specifically, *Agrobacterium* with plasmid PHP86491 (SEQ ID NO: 183) (Agro1) comprising two "Trait" expression cassettes (ZS-GREEN and ZM-HRA) was used alone as a control treatment. *Agrobacterium* (Agro2) with plasmid PHP88158 (SEQ ID NO: 182) comprising a WUS expression cassette operably linked to a 3× enhanced *Zea mays* PLTP (ZmPLTP) regulatory element and a CRC expression cassette operably linked to the NOS promoter regulatory element was used a positive control. For treatment 3 *Agrobacterium* with plasmid RV020636 (SEQ ID NO: 186) (Agro3) comprising a WUS expression cassette operably linked to a 3× enhanced ZmPLTP regulatory element with a maize-derived enhancer element (EME) positioned in triplicate (3XEME) near the ZmPLTP promoter TATA box and a CRC expression cassette operably linked to the NOS promoter regulatory element was used. For treatment 4 *Agrobacterium* with plasmid RV022819 (SEQ ID NO: 187) (Agro4) comprising a WUS expression cassette encoding a translational fusion peptide comprising the WUSCHEL protein and the C-terminus 27 amino acids of the *Agrobacterium rhizogenes* GALLS protein (ZM-WUS2:GALLS$^{C27}$) operably linked to a 3× enhanced ZmPLTP regulatory element and a CRC expression cassette operably linked to the NOS promoter regulatory element was used. For treatment 5 *Agrobacterium* with plasmid RV022820 (SEQ ID NO: 188) (Agro5) comprising a WUS expression cassette encoding a translational fusion peptide comprising the WUSCHEL protein and the C-terminus 127 amino acids of the *Agrobacterium tumefaciens* Virulence F (virF) protein (ZM-WUS2:virF$^{C127}$) operably linked to a 3× enhanced ZmPLTP regulatory element and a CRC expression cassette operably linked to the NOS promoter regulatory element was used.

Following maize transformation of each haploid embryo as described in Example 3, somatic embryogenesis on each treated haploid explant was activated. After approximately 6-10 days the proliferating callus tissue of each treated haploid embryo was dissected, and each portion of dissected tissue was transferred to maturation medium (289Q) with 0% colchicine and cultured at 26-28° C. under dark conditions. After approximately 6-10 days the sub-cultured tissues were transferred to a light culture room at 26° C. until healthy plantlets with good roots developed. Approximately 7-14 days later, plantlets were transferred to flats containing potting soil and grown for 1 week in a growth chamber and subsequently grown for an additional 1-2 weeks in the greenhouse, and then transplanted to soil in pots and grown under greenhouse conditions.

After regenerated plants were grown on soil, a leaf tissue sample was collected from each clonal plant, DNA was isolated, and a diagnostic PCR-based assay was performed to detect the presence/absence of the morphogenic gene expression cassette to determine the number of transgenic plants in response to treatments using each different morphogenic gene expression cassette. Additionally, isolated DNA was used for genotyping using a PCR-based genetic marker assay.

The genotypic data was used to determine allelic states inherited at genome-wide marker loci. The genotypic data was used to create a dendrogram representing the genetic distance between and within clonally-derived groups, or "clone sets", whereby genetic distance measured using allelic scores per assay states were graphically plotted to represent relatedness. Within clone sets, inheritance patterns of allelic states were also examined using ideograms displaying the inheritance of parental alleles across the physical map of the ten (10) maize chromosomes.

Transformation levels were determined by computing the number of plants testing positive for the presence of sequences of the morphogenic gene expression cassette relative to the total number of sampled plants (transgenic %) with the results shown in Table 16.

The results for the positive control treatment using (PHP88158 (SEQ ID NO: 182)) exhibited a low percentage of plants. Two percent (2%) of the regenerated plants, tested positive for the presence of the morphogenic gene expression cassette. The results for clonal plants using morphogenic protein variants including the WUSCHEL-GALLS (GS$^{C27}$) translational fusion (RV022819 (SEQ ID NO: 187)) and the WUSCHEL-virF$^{C127}$ translational fusion (RV022820 (SEQ ID NO: 188)) showed relatively higher levels of regenerated plants, ranging from 9 to 47% of the clonal plants testing positive for the presence of the morphogenic gene expression cassette.

The results for the treatment using RV020636 (SEQ ID NO: 186) showed that use of an altered expression maize element (3XEME) in the ZmPLTP regulatory sequence operably linked to the WUS gene in the morphogenic gene expression cassette encoding the original WUSCHEL peptide improved the regeneration of non-transgenic, wild type haploid plants. Here, for 269 tested plant tissues, no plants tested positive for the morphogenic gene expression cassette indicating an improved utility for generating wild type haploid plants.

TABLE 16

Percentage of clonal haploid plants with or without a morphogenic gene T-DNA

| "Altruism" Agrobacterium Strain | Transgenic/Total | Transgenic (%) |
| --- | --- | --- |
| (PHP88158 (SEQ ID NO: 182)) (3XENH-WUS control) | 3/136 | 2% |
| RV020636 (SEQ ID NO: 186) (3XENH-3XEME-WUS) | 0/269 | 0% |
| RV022819 (SEQ ID NO: 187) (WUS-GALLS$^{C27}$ fusion) | 29/336 | 9% |
| RV022820 (SEQ ID NO: 188) (WUS-virF$^{C127}$ fusion) | 119/252 | 47% |

The distribution of clonal plants produced per haploid explant treated using RV020636 (SEQ ID NO: 186) was determined. On average, 4.85 clonal plants per treated haploid embryo was observed after treating 220 haploid embryos (See FIG. 1). Given these results, Agrobacterium with the RV020636 plasmid (SEQ ID NO: 186) was identified as the preferential treatment method for obtaining clonal production of wild type, non-transgenic haploid plants.

Genotyping assay results for 253 sampled clonal individuals originating from 77 RV020636-treated haploid embryos scored using over 7000 genetic marker loci demonstrated 92% (233 of 253) of the genotyped samples had equal to or greater than 99% genetic identity within clone groups. A clustering of clone sets was observed when genetic relatedness was computed and graphically represented using a dendrogram, showing that these clones were stably produced with highly similar genomes (data not shown). Within clone sets, inheritance patterns of allelic states displaying the inheritance of parental alleles across the physical map of the ten (10) maize chromosomes confirmed the utility of this method for obtaining clonal plants per treated maize haploid embryo (data not shown).

These experiments identified that particular "Altruism" plasmids exhibited variation in producing either wild type or transgenic plants (see Table 16). Plasmid RV020636 (SEQ ID NO: 186) was identified as an exemplary "Altruism" plasmid for creating a population of non-transgenic, wild type haploid plants, which upon doubling, as described in Example 6, maximizes the number of selectable individuals created in a given doubled haploid (DH) population. These methods were used to improve the effective population size of a breeding population.

Example 6: Generating Clonal Doubled Haploid Maize Plants

Approximately 8-72 hours after performing the RV020636 transformation method using a morphogenic developmental protein, described in Example 5, treated haploid embryos were transferred onto a medium with a chromosome doubling agent, colchicine, and placed into a dark tissue culture room (28° C.). The amount of colchicine used in medium is generally 0.01%-0.2% (400-600 mg/L). Specifically, 0.05% (500 mg/L) colchicine was used in these experiments. After 8-72 hours of chromosome doubling treatment, the treated embryos were transferred and cultured using media without a chromosome doubling agent, for example to maturation medium (289Q medium).

Using the methods disclosed herein, over 60% of haploid embryos successfully responded to the colchicine doubling agent compared to 20-25% (data not shown) previously reported in the literature. In addition, the propagation of chromosome-doubled, clonal haploid maize embryos resulted in an improved success rate of self-fertilization (fertile). In these experiments, 51 clone sets, each comprising two clonal, first generation (D0) plants, were grown using standard greenhouse conditions. Reproductive success was defined as an individual's production of seed, the D1 seed, after self-fertilization of each plant. As shown in Table 17, over 60% of the diploidized haploid embryos were successfully self-fertilized (fertile) compared to 8-10% (data not shown) previously reported in the literature. Table 17 also provides reproductive fitness scores for these 51 DH clone sets.

TABLE 17

Reproductive success of first generation (D 0) clonal doubled haploids

| Fitness Description | Count | Percentage (%) |
| --- | --- | --- |
| Male Sterile + Female Sterile | 2 | 4 |
| Male Sterile + Asynchronous Flowering | 2 | 4 |
| Female Sterile + Asynchronous Flowering | 1 | 2 |
| Asynchronous Flowering | 2 | 4 |
| Asynchronous Flowering + No Seed Set | 1 | 2 |
| No Seed Set + Male Sterile | 1 | 2 |
| Male Sterile + Runt | 1 | 2 |
| Female Sterile | 1 | 2 |
| Runt | 1 | 2 |
| Pollination unknown | 1 | 2 |
| Fertile | 38 | 75 |
| Total Events | 51 | 100 |

Given these results, it is expected that the methods of the present disclosure will provide further improvements in productivity by increasing reproductive successes, for example, by performing cross-fertilizations within clone sets when the clones reproductively complement one another. Additionally, Female Sterile, Male Sterile+Runt, and Asynchronous Flowering phenotypes which together represent in Table 17 a cumulative 14% of the observed phenotypes can likewise be used to improve productivity by further increasing reproductive successes. For example, if multiple clones are grown and such clones can reproductively complement each other, then this result indicates that within a clone set, cross fertilization between clones can further improve productivity (the production of seed) with levels up to 84% success in propagating the next generation of seed for a DH line. This result is an improvement in comparison to results of only up to 10% as previously reported.

While these D0 plants were being grown, it was noted that many clone sets exhibited uniformity of morphological phenotypes within a set, including characteristics such as plant height, leaf margin width, ear height, tassel emergence, shoot emergence and silk emergence (data not shown). In contrast, as reported in the art chromosome doubling treatments with colchicine produce negative pleiotropic effects within clone sets. In addition to observing uniform phenotypes within clone sets, it was also observed using the present methods that there was morphological variation between clone sets in a manner consistent with the expected variation of a genetically diverse population of segregant F2 generation plants. These results show that the methods of the present disclosure provided additional improvements in comparison to current methods practiced in the art.

Example 7: Selecting Clonal Doubled Haploids with Optimal Genomic Estimated Breeding Values The following experiments demonstrate a method comprising genotyping cells derived from a clonal explant to identify, select, and propagate desirable clonal DH lines for breeding efforts.

Genomic selection methods estimate the effects of genome-wide molecular markers to calculate genomic estimated breeding values (GEBVs) for individuals without phenotypes. For example, GEBV can be used as a selection criterion by predicting phenotypic performance using genetic marker data that measure allelic states at genome-wide loci. By sampling a DH line tissue, isolating DNA from the tissue sample, and genotyping each sample as described in Example 5, it is possible to determine allelic inheritance patterns at genome-wide loci for computing a GEBV per DH line.

Breeding programs typically use DH populations of a certain size determined in part by constraints on available breeding resources, such as limited land area available for growing plants. As described in Example 6, one problem in the current state of the art is productivity losses during DH production, for example, with losses typically up to or exceeding two-thirds of all sampled haploid embryos. One additional negative consequence caused by this attrition is the increased cost for genotyping all sampled haploid embryos and the risk that these genotyped samples will fail to develop into fertile plants. Hence, in the current state of the art, genotyping is typically performed in the subsequent generation—a process that includes the cost of goods for generating the entire DH population.

As demonstrated in Example 6 where one section of the treated explant was used for DNA isolation and used to characterize the presence/absence of a T-DNA while other sections were used to obtain a clone set per treated haploid embryo, it is expected that such DNA can be used to obtain genetic data for computing a GEBV per DH line, ideally before growing the DH plants to maturity.

Figure 2A:
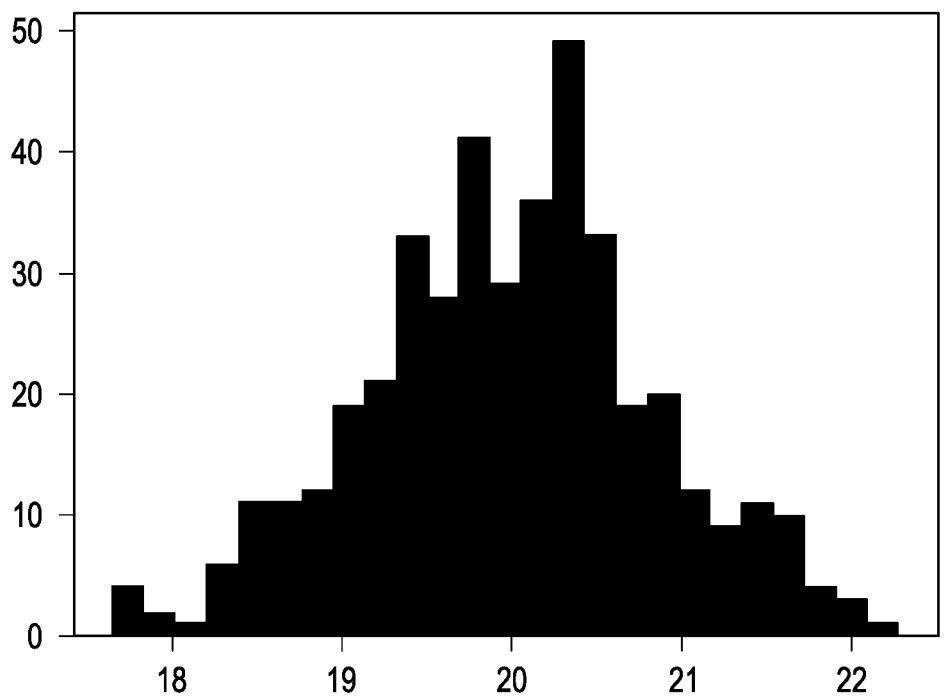
FIG. 2 shows histogram distributions of genetic estimated breeding values (GEBVs) as described in Example 7. Histogram distribution for the count of DH lines (y axis) in response to estimated breeding values (x axis) show phenotypic predictions for grain moisture (FIG. 2A), grain yield (FIG. 2B), plant height (FIG. 2C) and ear height (FIG. 2D).
Figure 2B:
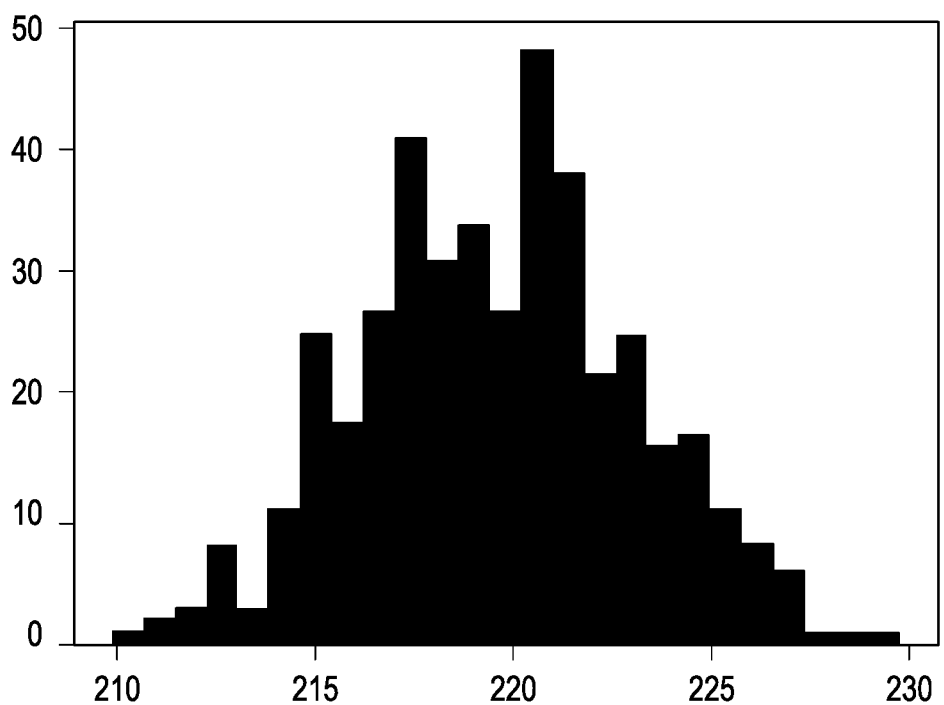
Figure 2C:
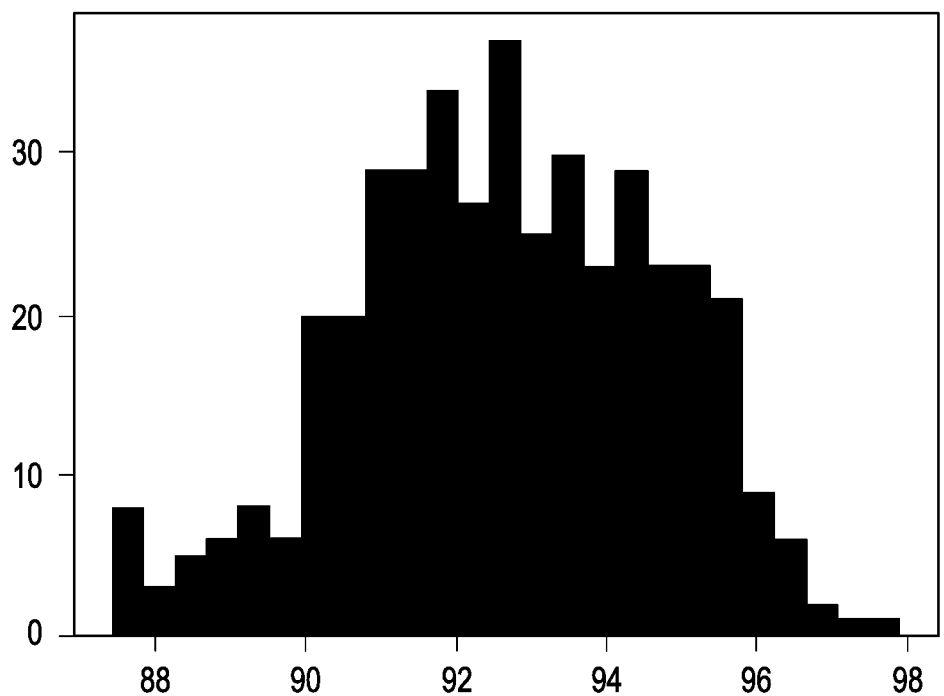
Figure 2D:
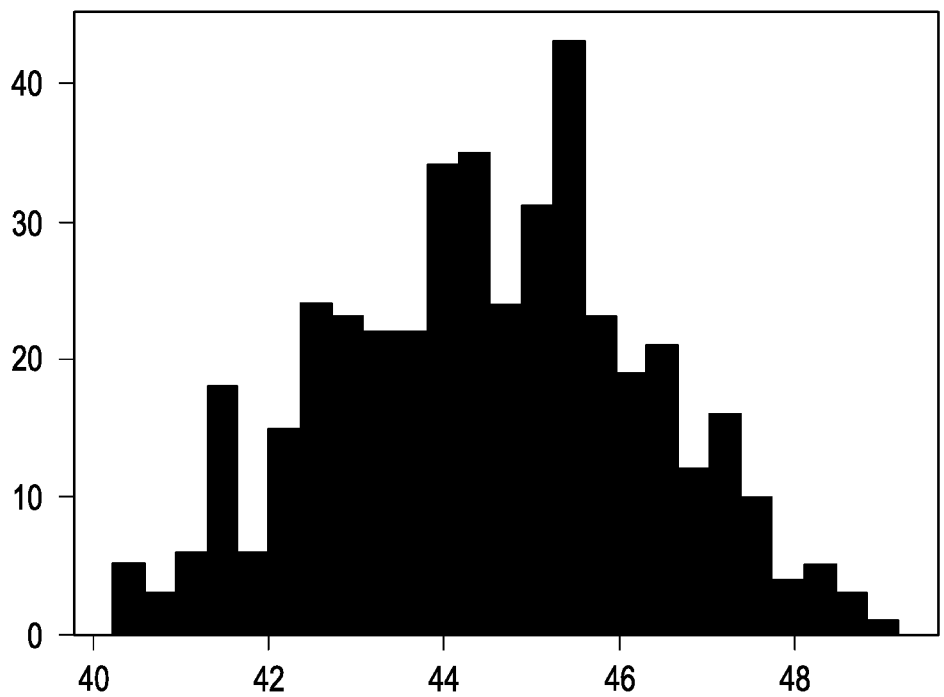
Figure 3:
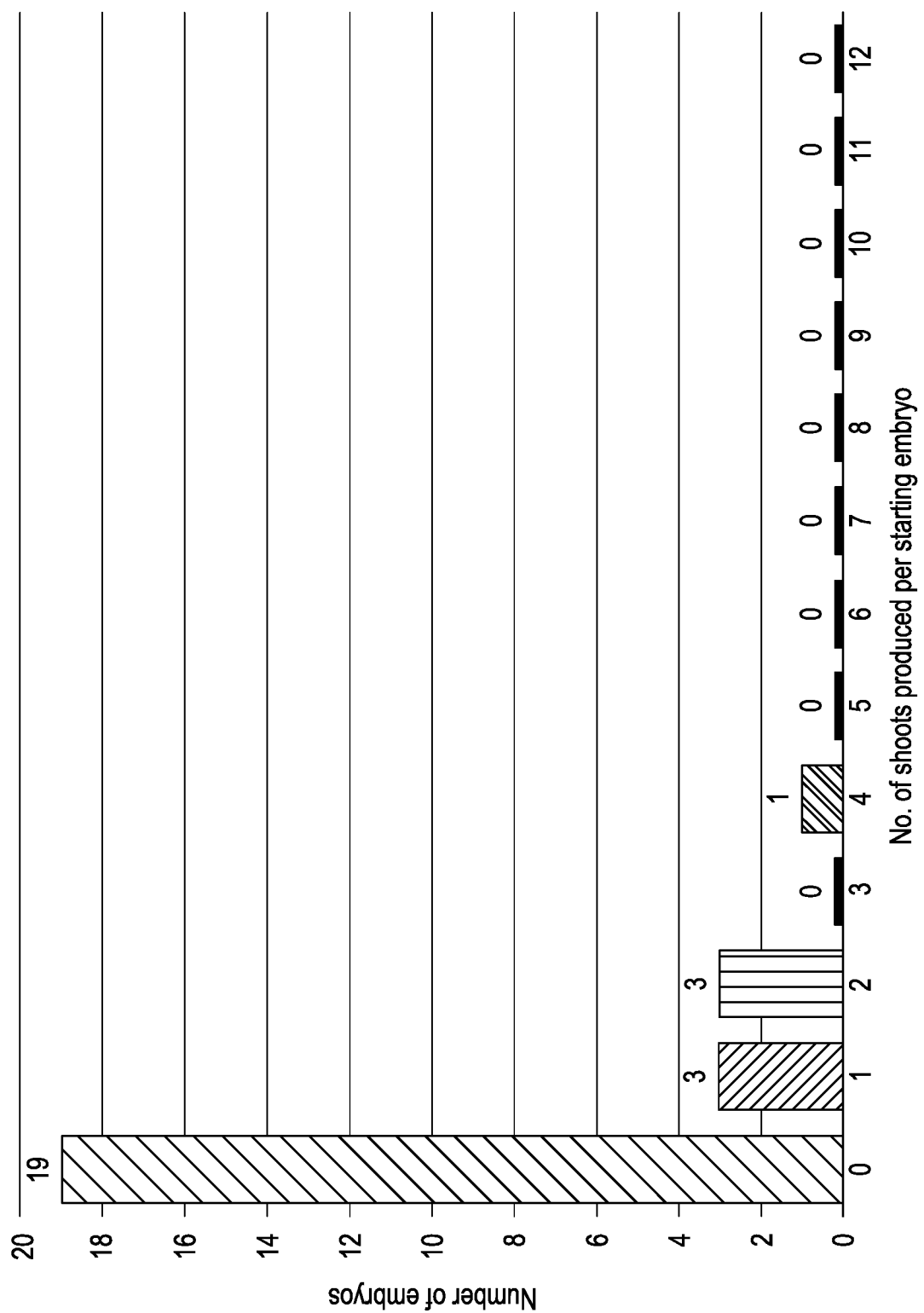
FIG. 3 shows the number of wild-type wheat R0 plants recovered (x axis) per starting embryo (y axis) after *Agrobacterium* infection with no T-DNA. A total of 26 immature embryos were infected with the *Agrobacterium* with a cumulative production of 7 shoots resulting in a 27% propagation frequency.
Figure 4:
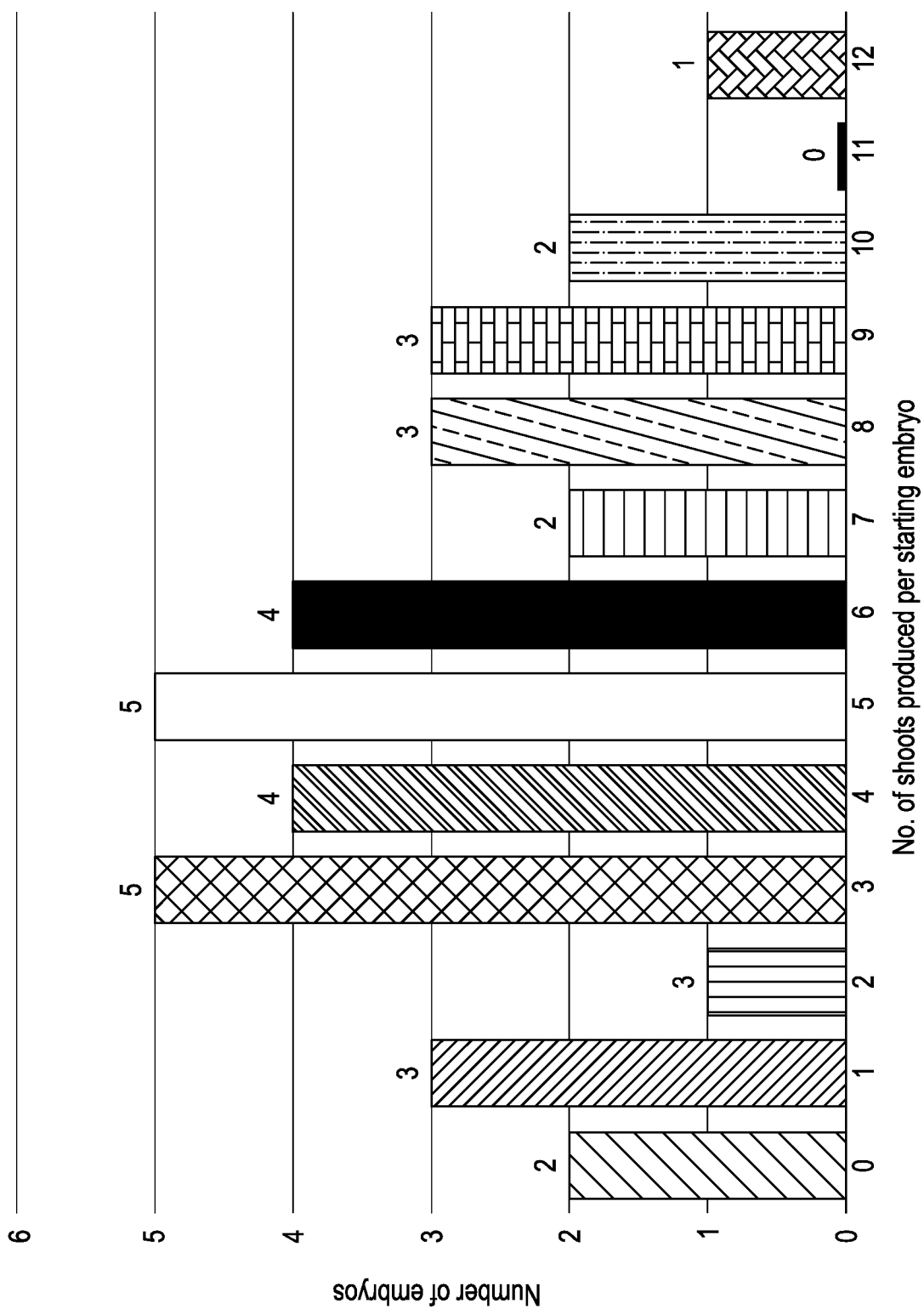
FIG. 4 shows the number of wild-type wheat R0 plants recovered (x axis) per starting embryo (y axis) after *Agrobacterium* infection with 3XENH::PLTP::WUS2. A total of 35 immature embryos were infected with the *Agrobacterium* with a cumulative production of 182 shoots resulting in a 520% propagation frequency.
Figure 5:
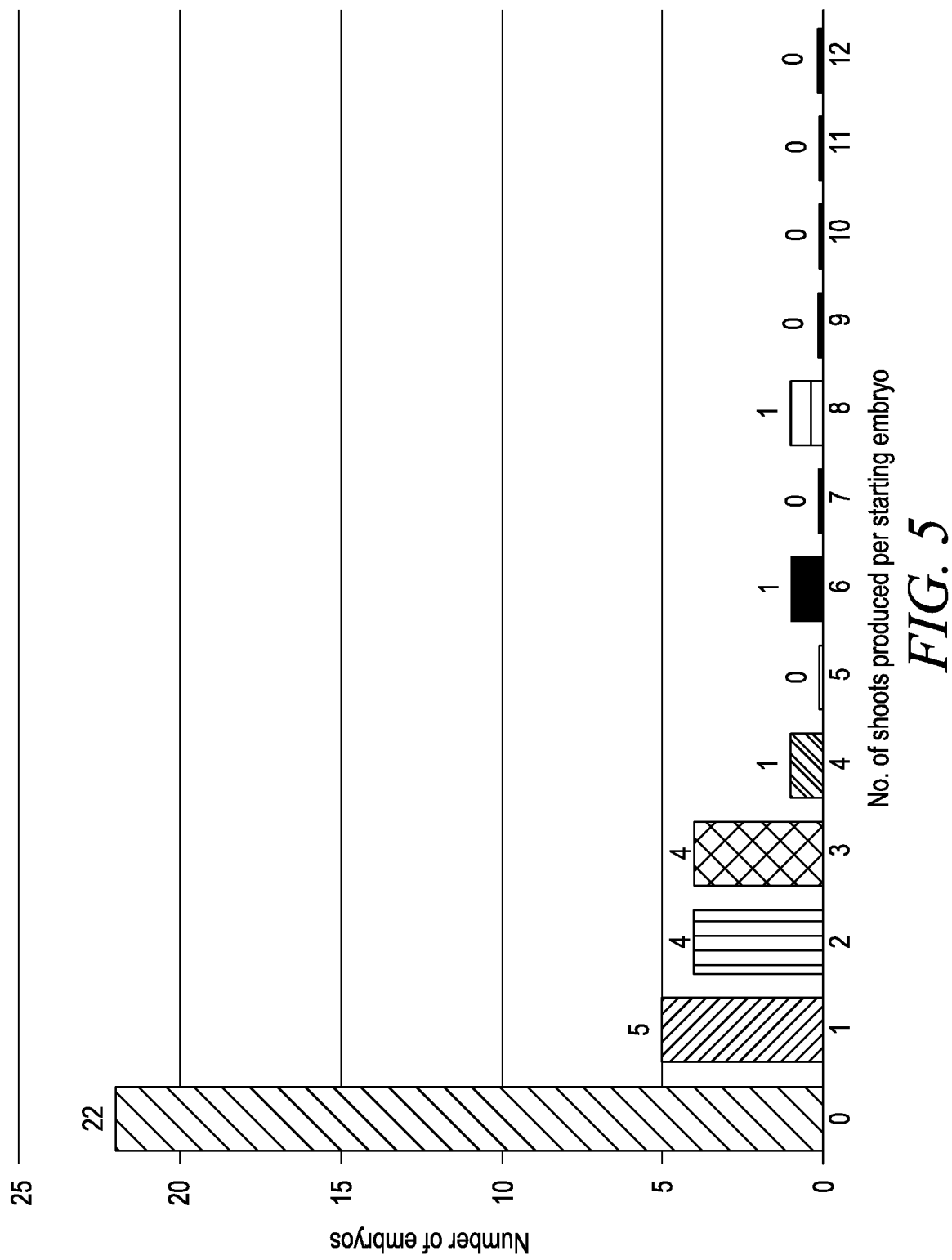
FIG. 5 shows the number of wild-type wheat R0 plants recovered (x axis) per starting embryo (y axis) after *Agrobacterium* infection with PLTP::ODP2. A total of 38 immature embryos were infected with the *Agrobacterium* with a cumulative production of 43 shoots resulting in a 113% propagation frequency.

For example, a breeding cross was created using the methods as described in Example 4 and the population of treated haploid embryos was genotyped (data not shown). The genetic data set was used to calculate GEBVs for each treated haploid embryo being propagated, specifically GEBVs for moisture, yield, plant height, and ear height. The resulting GEBVs were graphed as histogram distributions for each trait, with the count of DH lines shown in response to the predicted phenotypic values per trait. FIG. 2 shows these histogram distributions of genetic estimated breeding values (GEBVs). Histogram distribution for the count of DH lines (y axis) in response to estimated breeding values (x axis) show phenotypic predictions for grain moisture (FIG. 2A), grain yield (FIG. 2B), plant height (FIG. 2C) and ear height (FIG. 2D). As a result, using the methods of the present disclosure, it is shown how doubled haploid populations can be characterized using GEBVs, thereby facilitating selection for further plant breeding based on GEBVs.

In the method of the current example, DNA extracted from sampled cells was used for genetic marker analyses. In another aspect, it is understood that sampled cells can also be characterized using other methods, including but not limited to extraction of RNA, proteins, chromatin, and or metabolites.

It is expected that enriched DH populations based on such selections using the methods of the present disclosure will phenotypically outperform a randomly generated population. Thus, the methods disclosed herein are expected to favorably impact the rate of genetic gain in a breeding program. In addition, the methods disclosed herein can reduce input costs when using GEBVs as a selection criterion earlier in the DH production process, thereby improving productivity of breeding programs.

Example 8: Generating Artificial Seed

The following experiments demonstrate clonally propagated somatic embryos created using the methods described herein are useful for creating artificial seed, for example artificial seed using clonal somatic embryos derived from an F1 hybrid cross.

F1 hybrid embryos are produced by crossing two inbred parental lines where one parent is the female parent (ear donor) and the second parent the male parent (pollen donor). The two plant varieties can be cross fertilized in a manner that prevents any outcrossing to generate F1 hybrid embryos. When the two parents are each homozygous at all loci genome wide, it is expected that the resultant embryo will be heterozygous at all loci genome-wide. The methods of the present disclosure collect an immature F1 hybrid embryo for treatment as described below.

Using methods as described above to treat an F1 embryo, it is expected clonal somatic embryos will be produced. The clonal somatic embryos can be cultured to completion of the morphogenesis phase. The mature clonal somatic embryos can then be separated in a manner allowing each clonal somatic embryo to be collected. An isolated clonal somatic embryo may be further treated using in vitro tissue culture methods to promote somatic embryo maturation resulting in the induction of seed dormancy, a quiescent state allowing somatic embryos to survive periods unfavorable for seedling germination.

For example, methods for producing a mature embryo can include enhancing development of the proembryo into an embryo by promoting cleavage of proembryo cells using a modified basal medium containing a plant growth regulator selected from the group consisting of auxins, cytokinins, cyclitols and a mixture thereof.

Sub-culturing a developed embryo on a modified medium containing abscisic acid and a reduced concentration of plant regulators in darkness or in a weak diffused light for 1-8 weeks inhibits further proembryogenesis. Sub-culturing the embryo on a modified basal medium in continuous light for about 7 to 8 weeks generates elongated somatic embryos. Converting elongated somatic embryos into mature embryos is performed by further culturing the elongated embryos on a modified basal medium and recovering the mature embryo.

Artificial seed is made using methods comprising encapsulating a mature somatic embryo with nutritive and protective layers to allow germination under favorable conditions like a natural seed. It is expected that the artificial seed will protect the somatic embryo from mechanical damage during manipulation and transport, as well as provide nutritive support for germination of the somatic embryo to allow plant growth and development after sowing.

Example 9: Generating Clonal Doubled Haploids with a Targeted Genome Modification The following experiments demonstrated the stimulation of somatic embryogenesis in a plant cell by the expression of WUS2 protein in a plant cell wherein the plant cell stimulated to undergo somatic embryogenesis is not the plant cell expressing the WUS2 protein. In this method, the plant cell stimulated to undergo somatic embryogenesis is a second plant cell wherein the WUS2 protein activity is provided by a first plant cell that expresses a first T-DNA, for example from the plasmid RV020636 (SEQ ID NO: 186) (morphogenic gene expression cassette) as described in Example 5. The second plant cell is simultaneously provided a T-DNA from a second *Agrobacterium*. The second T-DNA provided by the second *Agrobacterium* contains a genome modification expression cassette, thereby allowing recovery of a genome-modified, double haploid clone set. These plant cells were genome modified while containing no T-DNA from the morphogenic gene expression cassette(s).

Specifically, immature haploid embryos of a maize F1 hybrid crossed with a haploid inducer as described in Example 4 were transformed using *Agrobacterium* strain LBA4404 THY—(See U.S. Pat. No. 8,334,429 incorporated herein by reference in its entirety) as described in Example 3.

A.) In Vitro Gene Editing and Clonal Doubled Haploid Production Using Plasmids RV020636 (SEQ ID NO: 186) and RV006010 (SEQ ID NO: 189)

A first *Agrobacterium* strain comprising plasmid RV020636 (SEQ ID NO: 186) was used as described in Example 5 and mixed with a second *Agrobacterium* strain comprising plasmid RV006010 (SEQ ID NO: 189). The *Agrobacterium* mixture contained a ratio of 95% of the *Agrobacterium* strain comprising plasmid RV006010 plasmid (SEQ ID NO: 189)+5% of the *Agrobacterium* strain comprising plasmid RV020636 (SEQ ID NO: 186). The *Agrobacterium* mixture was used to transform haploid embryos. The RV006010 T-DNA (SEQ ID NO: 189) contains a polynucleotide expressing a functional Cas9 protein, two gRNAs for cleaving two target sites at ZM-NAC7 (SEQ ID NO: 343), an embryo-expressed cyan fluorescent protein, a neomycin phosphotransferase II (nptII) gene conferring resistance to the kanamycin, and a maize-optimized Cre recombinase. In this construct, Cre activity excised the T-DNA polynucleotide sequence encoding the Cas9 protein, two gRNAs, and the Cre recombinase coding sequences resulting in a T-DNA conferring a cyan color marker and kanamycin resistance.

Following the methods as described in this Example 9 and in Examples 5 and 6, sixteen (16) clone sets were potted in soil, wherein each clone set comprised four clonal plants per treated haploid embryo. Plants surviving transplanting to soil were used for leaf tissue sampling.

After plantlet regeneration as described in Example 6, leaf tissue was sampled and the ZM-NAC7 target site (SEQ ID NO: 343) was sequenced for evidence Cas-mediated gene editing.

When haploid embryos were co-infected with this *Agrobacterium* mixture and diploidized as described in Example 6, eighty-nine (89) D0/T0 plants were regenerated from a total of twenty-one (21) clone sets each clone set having one or more clonal plants produced per treated haploid embryo. Each plant was tested for copy numbers of the RV020636 (SEQ ID NO: 186) and RV006010 (SEQ ID NO: 189) T-DNA.

A clone set comprising four (4) clonal doubled haploid plants was identified containing only a single copy of the RV006010 T-DNA (genome modification expression cassette) with no integration of the WUS-containing T-DNA (RV020636).

Sequencing analysis at the ZM-NAC7 target site (SEQ ID NO: 343) for the 4 clonal plants (4.6%) indicated gene editing activity at the target site as evidenced by a spectrum of minimally SDN-1 mutations present within each sampled plant (see Table 18). Three of the four plants exhibited evidence for both gRNAs being recruited to the target site, as evidenced by either an inversion of the DNA sequence between the two gRNA target sites or as indicated by the deletion of the DNA sequence between the two gRNA target sites, herein called a "dropout", likely repaired by a non-homologous end joining (NHEJ) mechanism (see Table 18). The two clonal plants with mutated alleles indicated that a functional Cas9-rRNA ribonucleoprotein complex modified the DNA at the target site using this method.

It is expected that certain mutations will be transmitted via the germline into the next generation, making this useful for obtaining a genome-modified, double haploid clone set lacking a T-DNA with a morphogenic expression cassette(s).

B.) In Vitro Gene Editing and Clonal Doubled Haploid Production Using Plasmids RV022820 (SEQ ID NO: 188) and RV006010 (SEQ ID NO: 189)

As show in in Table 16, *Agrobacterium* strains comprising different plasmids affected both the induction of somatic embryos and the frequency of regenerated plants that had T-DNA with a morphogenic gene expression cassette(s). These results showed that a stronger regulatory element (e.g. enhancement due to the presence of 3XEME sequences within the promoter) such as that found in plasmid RV020636 (SEQ ID NO: 186) T-DNA increased the total number of clonal plants generated and reduced the frequencies of the plants having a stably incorporated morphogenic gene expression cassette T-DNA insertion. Alternatively, as shown in Table 16, *Agrobacterium* strains comprising plasmids with expression cassettes encoding WUS fusion proteins (e.g. RV022819 (SEQ ID NO: 187) and RV022820 (SEQ ID NO: 188)) increased the total number of clonal plants generated and increased the frequencies of the plants having a stable morphogenic gene expression cassette T-DNA insertion.

Further experiments were conducted to examine how a plasmid other than RV020636 (SEQ ID NO: 186) affected recovery of clonal doubled haploid plants containing the desired gene edit provided by plasmid RV006010 T-DNA (SEQ ID NO: 189) comprising the Cas9-mediated "trait" required for gene editing at the ZM-NAC7 genomic target site (SEQ ID NO: 343). In this experiment, RV022820 (SEQ ID NO: 188) was used to stimulate somatic embryogenesis, rather than RV020636 (SEQ ID NO: 186). The RV022820 T-DNA (SEQ ID NO: 188) comprises a polynucleotide encoding a WUS-virF$^{C127}$ fusion operably linked to the enhancer-modified ZmPLTP promoter. Specifically, a first *Agrobacterium* strain comprising plasmid RV022820 (SEQ ID NO: 188) was used as described in Example 5 and mixed with a second *Agrobacterium* strain comprising plasmid RV006010 (SEQ ID NO: 189). The *Agrobacterium* mixture contained a ratio of 95% of the *Agrobacterium* strain comprising plasmid RV006010 (SEQ ID NO: 189)+5% of the *Agrobacterium* strain comprising plasmid RV022820 (SEQ ID NO: 188).

Following the methods as described in this Example 9 and in Examples 5 and 6, thirteen (13) clone sets were potted in soil, wherein each clone set comprised two clonal plants per treated haploid embryo. Twenty-three plants survived transplanting to soil and leaf tissue was sampled. DNA was isolated and diagnostic assays were performed to first test for the presence/absence of the T-DNA derived from the RV022820 plasmid (SEQ ID NO: 188) comprising the morphogenic gene cassette used to stimulate somatic embryogenesis (clonal propagation treatment). Individuals scored as absent for plasmid RV022820 T-DNA were advanced for sequencing analysis at the target site, ZM-NAC7 (SEQ ID NO: 343), for evidence of gene editing.

Of the twenty three (23) plants sampled for sequencing after being potted in soil, each plant was scored as lacking the RV022820 T-DNA comprising the morphogenic gene cassette used to stimulate somatic embryogenesis and were thus considered clonal D0 plants capable of having been genome modified. The resulting sequence analysis at the ZM-NAC7 genomic target site (SEQ ID NO: 343) showed evidence of gene editing in two (2) clone sets (four (4) plants total; 17.4%) and in this result no evidence of any deletion "dropouts" were observed as reported in Table 18.

In the first clone set, consisting of two plants derived from one haploid embryo, the analysis showed that the two plants had the same mutation at the Cas9 target site and both plants were scored as having a stable RV006010 T-DNA integration.

In the second clone set, consisting of two (2) plants derived from one haploid embryo, the analysis showed that the two plants were mutated at the Cas9 target site, with each plant having a different mutation. In this clone set however, one plant was characterized as having a stable RV006010 T-DNA integration event, while the second plant was scored as lacking stable integration of the RV006010 T-DNA. This result showed that the in-vitro treatment used herein produced a genome-modified plant without stable integration of the RV006010 T-DNA encoding the gene modification trait. While not wishing to be bound by any one theory it is believed that such a result was achieved from transient expression of the T-DNA, thereby producing a mutation at the genomic target site. Regeneration of a plant with such a gene edit was notably achieved with no detection of the WUS-containing T-DNA (RV022820), and thus was stimulated after being contacted by WUS protein activity. This resulted in obtaining a gene-edited D0 plant derived from a plant cell that had never been stably transformed with a foreign DNA.

It is expected that certain mutations will be transmitted via the germline into the next generation, and are useful for obtaining a genome-modified, double haploid clone set lacking a T-DNA with a morphogenic expression cassette(s). Given a D0 plant was derived from a plant cell having been transiently contacted by only the WUS protein, Cas9 protein and gRNA(s) provided to a plant cell, the method of the present disclosure obtained a genome-modified doubled haploid plant wherein that plant per se was obtained without the process of introducing a polynucleotide into the genome of the plant.

C.) In Vitro Gene Editing and Clonal Doubled Haploid Production Using Plasmids RV020636 (SEQ ID NO: 186) and RV036376 (SEQ ID NO: 317)

As described in section A.) and section B.) of this Example 9, methods for obtaining clonal doubled haploid plants having a targeted genome modification were described and clonal doubled haploid plants having a targeted genome modification were obtained. Additional experiments were performed to further improve this capability by further stimulating embryogenesis and the propagation of clonal plants having a targeted genome modification.

For this purpose, plasmid RV036376 (SEQ ID NO: 317) was constructed. Briefly, the T-DNA of the RV036376 plasmid (SEQ ID NO: 317) has the same gene editing components as used in the RV006010 plasmid (SEQ ID NO: 189), but plasmid RV036376 (SEQ ID NO: 317) also comprises a polynucleotide encoding a full-length BBM/ODP2 peptide operably linked to the Z. mays PLTP promoter and lacks the cyan fluorescent protein related sequences. In this construct, Cre activity excised the T-DNA polynucleotide sequence encoding the Cas9 protein, two gRNAs, Cre recombinase, and the BBM/ODP2, and resulted in a T-DNA conferring only kanamycin resistance.

Embryos were treated as described in this Example 9. Specifically, a first Agrobacterium strain comprising plasmid RV020636 (SEQ ID NO: 186) was used as described in Example 5 and mixed with a second Agrobacterium strain comprising plasmid RV036376 (SEQ ID NO: 317). The embryos were treated with the Agrobacterium mixture containing a ratio of 95% of the Agrobacterium strain comprising plasmid RV036376 (SEQ ID NO: 317)+5% of the Agrobacterium strain comprising plasmid RV020636 (SEQ ID NO: 186).

When co-infecting a plant cell with an Agrobacterium comprising plasmid RV036376, co-expression of the BBM/ODP2 peptide along with the expected ribonucleotide protein complex (RNP) activity improved the propagation of clonal plants having Cas9-mediated gene editing at the ZM-NAC7 genomic target site (SEQ ID NO: 343). Specifically, the combined protein activity of simultaneously provided WUSCHEL and BABYBOOM/ODP2 to a plant cell improved the propagation of clonally-derived embryos into regenerated plants and the edited frequency of those regenerated plants.

In another aspect, it is expected that other such proteins useful in the present disclosure include, but are not limited to, other morphogenic genes, such as LEC1 and/or a geminivirus RepA gene as well as, other morphogenic genes disclosed herein.

Following the methods as described in this Example 9, 16 clonal sets were potted in soil with each clone set comprising six clonal plants per treated haploid embryo (total of 96 plants). From these plants, leaf tissue samples are collected, DNA is isolated, and diagnostic assays are performed to first test for the presence/absence of the T-DNA derived from the RV020636 plasmid (SEQ ID NO: 186). Individuals scored as absent for RV020636 T-DNA are advanced for sequencing analysis at the target site for evidence of gene editing.

The resulting plants can be used for intra-clonal cross-breeding, for example in the methods of obtaining plants for recovery of an allelic series as described below.

The experimental results of section A.) and B.) described obtaining clonal doubled haploid plants containing a targeted genome modification. Specifically, the plant cell in the above methods was treated with a first T-DNA from a first Agrobacterium that provided only the WUS2 protein activity, thereby stimulating somatic embryogenesis, while a second T-DNA from a second Agrobacterium provided to the plant cell conferred genome modification capabilities. Gene-edited D0 plants derived from a maternal maize haploid cell were observed at a relatively low rate, for example with approximately 3% to 17% of the D0 plants had a target site mutation (see section A.) and B.) above).

In contrast to the above results in section A.) and B.) above, the results here show that the ability to regenerate clonal doubled haploid plants containing a targeted genome modification was further improved using Agrobacterium comprising plasmid RV036376, wherein the second T-DNA from the RV036376 plasmid conferred both genome modification capabilities and morphogenic gene expression of the BBM/ODP2 peptide.

Sixteen (16) clone sets were generated after treatment with a first *Agrobacterium* strain comprising plasmid RV020636 (SEQ ID NO: 186) mixed with a second *Agrobacterium* strain comprising plasmid RV036376 (SEQ ID NO: 317). For the sixteen (16) clone sets generated, each clone set had six (6) plants per treated embryo, a total of 83 plants were regenerated, transplanted, and had leaf tissue sampled. Isolated DNA used for sequencing analysis at the target site showed that 40 of these 83 plants were Cas9-mediated gene edited (40 of 83, 48.2%) and notably thirteen (13) of those 40 plants contained mutations corresponding to gene-edited SDN-2 "dropout" mutations (see Table 18).

The methods disclosed herein not only improve gene-editing efficiencies, for example both SDN-1 and SDN-2 mutations were achieved at greater efficiencies than previously reported in the art, the methods of the present disclosure also unexpectedly provided a genome-modified plant lacking any stably transformed foreign DNA. The methods of the present disclosure provided these results in relatively less time, with much greater agility, and with suitable scalability for meeting the unsolved needs of plant breeding programs to continue improving the phenotypic performance of elite germplasm than methods previously reported in the art.

TABLE 18

| Treatment Method | Clone Sets | Total D 0 plants | Sequenced D 0 plants | SDN-1 edit (% sequenced D 0) | SDN-2 edit (% sequenced D 0) |
|---|---|---|---|---|---|
| RV020636 (SEQ ID NO: 186) and RV006010 (SEQ ID NO: 189) | 21 | 89 | 87 | 4 (4.4%) | 3 (3.4%) |
| RV022820 (SEQ ID NO: 188) and RV006010 (SEQ ID NO: 189) | 6 | 26 | 23 | 4 (17.4%) | 0 (0%) |
| RV020636 (SEQ ID NO: 186) and RV036376 (SEQ ID NO: 317) | 16 | 96 | 83 | 40 (48.2%) | 13 (15.7%) |

Thus, the results demonstrated that using plasmid RV036376 improved not only clonal propagation per se, but also improved the ability to obtain clonal doubled haploid plants having a targeted genome modification. It is expected that the mutations will be transmitted via the germline into the next generation of plants providing a genome-modified, double haploid clone set lacking a T-DNA with a morphogenic gene expression cassette(s).

It is also expected that co-expression of other such morphogenic genes, or any gene product useful for promoting embryogenesis can be used in the manner described herein to improve both clonal propagation per se, as well as the recovery of genome-modified plants lacking T-DNA integration.

The results obtained using the methods of the present disclosure demonstrated a method for obtaining genome-modified doubled haploid plants. The present methods provided a notable improvement over methods previously reported in the literature. For example, as previously reported, a method of editing a haploid progeny using a pollen from a haploid inducer plant, wherein the inducer expresses a DNA modification enzyme and optionally at least one guide RNA, the capability for a transformed haploid inducer line to cause modifications at a target site in maize haploid progeny ranged from 4.7% to 8.8% and no results other than SDN-1 mutations were reported. In contrast, using the methods described herein provided significant improvements in gene editing efficiency and the range of edits obtained.

The methods disclosed herein for haploid induction editing technology (HI-edit) is useful in plant breeding methods and enables direct editing of elite inbred lines by a single cross. Using the methods of the present disclosure in a breeding program saves in labor costs and time because the present methods do not require the evaluation and selection of new events per construct per genome modification target each time a new genome modification is introduced into an elite breeding line or breeding population.

D.) Clone Selection, Clonal Propagation and Allelic Series Recovery

It is expected that each hemizygous, single copy plant will have the T-DNA (such as those T-DNAs described above) inserted at a random position in the genome. Additionally, it is expected that expression of the gene editing trait encoded in the "Trait" T-DNA (such as those T-DNAs described above) will express a ribonucleotide complex comprising a site directed nuclease and gRNA to create specific, targeted changes at the nuclease target site. For example, expressing a gRNA complexing with a CAS9 nuclease can cause a site directed mutation. Further, mutagenesis in a series of cells can result in a series of allelic mutation sets, wherein each individual derived from a cell can have a particular mutation.

Within a clone set, this method allows identifying and selecting individuals to cross fertilize, thereby creating an F1 hybrid within a clone set, wherein the F1 hybrid genome is expected to identical and homozygous genome-wide, except for: i) possible T-DNA integration sites that are hemizygous for the T-DNA, for example having the "Trait" T-DNA integrated at two independent loci inherited from the two clonal siblings used as parental lines, and ii) the genome will be heterozygous for two germline heritable mutations at the CRIPSP-CAS9 target site, wherein each site directed mutation is originally derived from a unique mutation event.

Thus, by self-fertilization of such an F1 genome and by growing the seed of this plant, the progeny in the next generation can be analyzed and segregant progeny inheriting wild type alleles in respect to T-DNA insertion sites can be selected. Amongst these individuals, genetic analysis of the inherited mutations at the target site allows identifying and selecting individuals homozygous for a heritable germline mutation. On average, it is expected such mutations will be segregating 1:2:1 with respect to the two heritable germline mutations. Recovery of the two respective homozygous classes thus allows obtaining clonal doubled haploid plants with a pair of allelic series of mutations that are useful for plant breeding purposes.

Repeating this process with additional clonal lines from within one clone set can be performed to expand the number of clonal lines that are each homozygous for an independent mutant allele at the nuclease target site.

The methods described here allow generating an allelic series of mutations within a clone set of a doubled haploid line.

In one aspect, the methods of the present disclosure allow for sampling and sequence verification of a modification at the target site prior to flowering, thus, providing the option to screen, select, and cross selected plants in a controlled manner. For example, within a clone set, here referred to as "intra-clonal cross-breeding", it is expected any randomly inserted T-DNA integration sites can be selected against in progeny produced from an intra-clonal F1 cross. It is expected that diagnostic assays for detecting T-DNA can achieve the identification of progeny that have inherited only wild type alleles in respect to parental T-DNA integration sites that become hemizygous in the intra-clonal F1 cross.

A second purpose for intra-clonal cross-breeding is the expectation that a gene edit can be fixed to homozygosity upon self-fertilization of the progeny having only wild type alleles in respect to parental T-DNA integration sites. In this manner, intra-clonal cross-breeding can provide an allelic series of mutations within a clone set.

This method offers a clear benefit for trait integration. For example, back-crossing of a trait locus is commonly used and that method requires first creating the edit in a transformable maize line. After that line is created, that line is then used as a "donor" parent, during a series of back-crossing to a recipient line, used as a "recurrent" parent. The purpose of back-crossing is to achieve recovery of the recurrent parent genome with only the introgression of the gene-modified target site locus from the "donor" parent. In comparison to the present disclosure, conventional back-crossing methods are more labor intensive and require more breeding time, notably as the number of parental conversions increases, for example, in comparison to an effort to introgress desired mutations into each doubled haploid line within a population as described herein.

Thus, the method described here presents a novel method for "forward" breeding of a gene-modified trait at the population level.

From a quantitative genetics perspective, the ability to derive an allelic series of mutations at a target site achieves other useful advantages for studying causal genotype-to-phenotype relationships. First, an allelic series within a clone set provides one level of genetic analysis that can be performed. Second, multiple allelic series for multiple clone sets comprises a second level of genetic analysis across a breeding population, or alternatively a multitude of populations, that can be performed.

Together, these results are expected to support novel plant breeding methods that are an improvement to the state of the art.

Example 10: Generating Maize Clonal Doubled Haploids Using Homology-Directed Repair (HDR)

The following experiments demonstrate using a gene targeting system comprising double strand breaks (DSB) at a site-specific genomic target site, or region, and homology directed repair (HDR) to facilitate directional integration of a desired nucleotide sequence into corresponding homologous recombination sites of a haploid plant genome.

Immature haploid embryos of a maize F1 hybrid crossed with a haploid inducer as described in Example 4 were transformed with *Agrobacterium* strain LBA4404 THY— (See U.S. Pat. No. 8,334,429 incorporated herein by reference in its entirety) as described in Example 3.

A first *Agrobacterium* strain comprising plasmid RV020636 (SEQ ID NO: 186) was used as described in Example 5 and mixed with a second *Agrobacterium* strain comprising plasmid RV006010 (SEQ ID NO: 189). The *Agrobacterium* mixture contained a ratio of 95% of the *Agrobacterium* strain comprising plasmid RV006010 plasmid (SEQ ID NO: 189)+5% of the *Agrobacterium* strain comprising plasmid RV020636 (SEQ ID NO: 186). In this experiment, *Agrobacterium* transformation methods are practiced as described in Example 3 as part of a mixture with another *Agrobacterium*, here containing a gene targeting plasmid with a T-DNA comprised of multiple "Traits" (for example a zinc finger nuclease, a donor excision template encoding a trait gene, and an anthocyanin color marker, see Table 9).

For treatment, *Agrobacterium* strains are mixed at a ratio of 95% Trait-containing plasmid (for example, PHP91522 (SEQ ID NO: 190) or PHP90308 (SEQ ID NO: 191)) to 5% WUS-containing plasmid (RV020636 (SEQ ID NO: 186), see Table 9). When haploid embryos are co-infected with this *Agrobacterium* mixture, transgenic T0 plants containing only a single copy of the "Trait" T-DNA (PHP91522 or PHP90308) with no integration of the WUS-containing T-DNA (RV020636) are regenerated. Upon expression of the Trait T-DNA (PHP91522 or PHP90308), activity of the enhanced zinc finger nuclease (EZFN) will excise the donor template encoded in the "Trait" T-DNA, thereby allowing homology directed repair and stable transgene integration at the targeted double strand break site.

Explants with excised donor templates can be detected using morphological detection of anthocyanins expressed by an anthocyanin regulatory protein resultant from excision of the donor template to allow gene regulation from the ZmGlob1 regulatory sequence. Stable transgenic plants are identified using positive selection, for example by identifying plants with herbicide resistance to glufosinate or haloxyfop for PHP91522 and PHP90308, respectively. It is expected that culturing such plants in the presence of a chromosome doubling agent as described in Example 6 will facilitate chromosome doubling and diploidization of the stable transgenic doubled plants.

Further, it is expected that each hemizygous, single copy plant with herbicide tolerance will have the "Trait" gene inserted at a targeted site in the genome and the remnant "Trait" T-DNA comprising the repaired T-DNA sequence inserted at a random position in the genome.

Within a clone set, this method allows identifying and selecting clonal individuals to cross fertilize, thereby creating seed of this cross that can be grown. Some progeny are expected to be wild type at loci segregating for each random T-DNA insertion site comprising the repaired "Trait" T-DNA sequence with also inheritance of alleles from both parental gametes with a successful gene targeting event at the targeted transgene integration site. Further propagation of such plants will then segregate as clonal doubled haploids with two copies of the "Trait" gene at the target site.

The methods of the present disclosure provide an improvement to the current state of the art by accelerating trait introgression using haploid induction breeding methods, thus, enabling forward breeding capabilities for site-directed transgene integration in doubled haploids without the need for backcrossing-mediated trait introgression.

Example 11: Generating Clonal Doubled Haploids with Reduced Frequencies of Transgenic Plants The following experiments demonstrate using a negative selection system to select against transgenic cells or resulting transgenic plants thereof, to produce non-transgenic, wild type clonal doubled haploid plants derived from maternal haploid cells.

Negative selection methods in plant cells that result in death of transformed cells are useful in the methods of the present disclosure. Conditional selection methods are useful in the methods of the present disclosure, for example substrate-dependent selection systems comprising transgenic cells expressing a gene useful for converting non-toxic agents to toxic agents that result in the death of the transformed cell. Genes used in plant cells for this purpose, include but are not limited to, the bacterial cytosine deaminase (codA) gene, that converts non-toxic 5-fluorocytosine to the toxic compound 5-fluorouracil, or the *Streptomyces griseolus* cytochrome P450 monooxygenase gene CYP105 A1 that converts non-toxic sulfonyl urea pro-herbicide R7402 to a phytotoxic agent are useful in the methods of the present disclosure. Of interest is the ability to first culture a treated explant in a growth medium without such a non-toxic agent thereby allowing growth of both transformed and non-transformed cells followed by transfer to a growth medium with such a non-toxic agent thereby promoting selection against the transformed cells and the resulting growth of non-transformed cells.

In the methods of the present disclosure a gene conferring conditional negative selection, for example the bacterial cytosine deaminase (codA) gene is cloned into a plasmid. Transformation is carried out as described above using the same steps through maize transformation and chromosome doubling followed by transfer of such embryos to a maturation medium with selection, for example the 289Q medium supplemented with 5-fluorocytosine. Alternatively, conditional selection methods can also be practiced during or after proliferating callus tissue of each treated haploid embryo is dissected. For example, by transferring each portion of dissected tissue being transferred to maturation medium (289Q) supplemented with 5-fluorocytosine and cultured at 26-28° C. under dark conditions.

It is expected that transfer to growth medium supplemented with a non-toxic agent will promote selection against transformed cells and resulting growth of non-transformed cells, thereby facilitating the creation of clonal doubled haploid populations with reduced frequencies of transgenic plants and elevated frequencies of non-transgenic, wild type plants.

Example 12: Generating Clonal Doubled Haploids from a Responsive Microspore-Derived Cell The following experiments demonstrated using a negative selection system to select against transgenic cells or resulting transgenic plants thereof, to produce non-transgenic, wild type clonal doubled haploid plants derived from paternal haploid cells.

In this method, embryogenic growth was stimulated in non-transformed cells, and particularly in a microspore-derived cell, thus the methods of the present disclosure are useful for generating populations of microspore-derived clonal doubled haploids. Microspores were extracted, isolated, and purified from a donor tissue or organ producing such gametic cells. These cells were cultured in a growth medium to induce an embryogenic response. The methods of the present disclosure provide the generation of corn microspore-derived embryos with improved frequency of responsive microspore-derived embryos in a genotype-independent manner.

Methods of the present disclosure were practiced using ATCC40520 corn microspores (see U.S. Pat. No. 5,602,310 incorporated herein by reference in its entirety) cultured in a petri dish in a 9% sucrose induction medium at 28° C. under dark conditions for seven (7) to twenty-one (21) days, preferentially fourteen (14) days after initiating the culture. During initial phases of corn microspore embryogenesis, the cellular response results in repeated cell divisions, thereby forming multicellular structures (MCS). With continued development, a MCS grows, resulting in embryo-like structures enclosed within the original microspore wall, known as the exine, the exine then characteristically degrades to allow further development into haploid embryos and regeneration of plantlets.

MCS were transferred from a liquid culture, collected in a 70 µm Fisher brand cell strainer (fisher scientific by Thermo Fisher Scientific catalog #FBH #22-363) and washed three times with 0.75 mL of 9% sucrose induction medium. The MCS were transferred from the cell strainer to a sterile 50 mL polypropylene conical centrifuge tube (Thermo Fisher Scientific catalog #14-432-22) with MCS cells suspended in a final 2.25 mL volume of 9% sucrose induction medium.

*Agrobacterium*-mediated transformation of MCS cells was performed as described in Example 3, including the preparation of the *Agrobacterium* master plant and growth of *Agrobacterium* on a solid medium as described above. Two plasmids were used in the current method (See Table 9) and each bacteria was resuspended into the liquid infection medium by vortexing with an optical density of 550 nm of the *Agrobacterium* suspension and then adjusted to a reading of 0.5 OD. The two strains were combined in a mixture (95% PHP86491 (SEQ ID NO: 183) and 5% PHP87078 (SEQ ID NO: 181)).

The MCS and the combined *Agrobacterium* were combined in a suspension using 0.5 mL of the suspended MCS cells and 0.05 mL combined *Agrobacterium* mixture, allowed to incubate for 5 minutes under sterile conditions, transferred to a solid medium (e.g. 605J), and incubated under dark conditions at 21° C. As a negative control, 0.5 mL of the suspended MCS cells were cultured in the same manner as described but without the combined *Agrobacterium* mixture within the solution. After 24 hours, each plate was transferred to 28° C. and incubated under dark conditions.

The results of this experiment indicated that microspore embryogenesis was stimulated in response to the combined *Agrobacterium* mixture treatment with treated paternal haploid cells transferred to 605J medium without selection after 72 hours.

In another example, the methods of the present disclosure can be practiced as described above with *Agrobacterium*-treated MCS transferred to a solid medium with antibiotic (e.g. 605T).

In another yet another example, the method of the present disclosure can use a plasmid as shown in Table 9 that co-expresses a gene conferring conditional negative selection, for example the bacterial cytosine deaminase (codA) gene as described in Example 11. The method for transformation can be practiced as described above using the same steps through maize transformation and chromosome doubling steps and then transferring proliferating callus tissue derived from a paternal haploid cell to a maturation medium with selection, for example 289Q medium supplemented with 5-fluorocytosine. Conditional selection methods can also be practiced during or after proliferating callus tissue of each treated microspore-derived embryo is dissected. For example, by transferring each portion of dissected tissue to maturation medium (289Q) supplemented with 5-fluorocytosine and cultured at 26-28° C. under dark conditions.

Example 13: Methods of In Vitro Plant Breeding

Meiosis is a process for forming haploid gametes from diploid germ cells, a process essential for sexually reproducing species to transmit genetic information to the next generation. Meiosis requires a specialized cell cycle consisting of one round of DNA synthesis followed by two successive rounds of M phase that reduces the number of chromosomes in the parent cell by half. After meiosis occurs, each haploid cell contains a mixture of genes inherited from the maternal and paternal genome following the principle of independent assortment. Independent assortment requires homologous pairs of chromosomes must be identified and matched, called pairing, during Meiosis I. The matched pairs must be physically interlocked by recombination, also referred to as exchange or crossing-over, resulting in meiotic recombination between two homologous chromosomes thereby producing the recombinant gametes. Methods manipulating control of a cell's regulation of mitosis-meiosis pathways are of interest to the present disclosure, specifically control of molecular mechanisms promoting a cell's commitment for entry into meiosis.

For breeding purposes, a cell containing chromosomal regions that are heterozygous can be used, wherein the desired outcome is the production of meiotic recombinant cells. The use of an F1 hybrid embryo resultant from a biparental cross is an exemplary cell type for this method. It is understood that other cell types, for example from subsequent generations or from other breeding approaches, such as backcrosses, can be generated, obtained, and used for treatment as described below.

Commitment to entry into meiosis comprises two parts: i) exit from the mitotic cell cycle and, ii) induction of the alternate meiotic cell cycle program. As described here, the former step for inducing mitotic cell cycle activity is stimulated in response to expression of a morphogenic developmental gene, for example as described in Example 5, wherein such treatments characteristically cause a relatively high mitotic activity that results in the induction of somatic embryogenesis. Although induction of the alternate meiotic cell cycle program is less well characterized, here the present disclosure describes treatments useful for controlling a cell's commitment to entry into meiosis.

Treatments useful for entry into meiosis include, but are not limited to, responses to reducing treatments that increase hypoxia and or lower cellular hydrogen peroxide levels, by either environmental or chemical means. Cell treatments providing activity of a gene product, or gene products, useful for committing entry of the cell into meiosis are also of interest.

In the current method, exposing a cell of an F1 embryo to redox-modulatory conditions is of interest.

Exposing a cell of an F1 embryo to redox-modulatory conditions comprises transfer of the treated cell to a hypoxia-inducing tissue culture system, such as use of a hypoxia incubator chamber (StemCell™ Technologies, catalog #27310) or use of oxygen-controlling biomaterials, such as hypoxia-inducible (HI) hydrogels that can provide three dimensional hypoxic microenvironments before, during, or after the induction of somatic embryogenesis. In this method, the treated cells are cultured in conditions to alter the redox potential of cells, thereby promoting acquisition of a germ cell fate upon exiting a mitotic cell cycle.

In another aspect, methods for exposing an embryo cell to redox-modulatory conditions include treatment of a F1 hybrid embryo by contacting the cell of a F1 hybrid diploid embryo with chemical treatments before, during, or after the induction of somatic embryogenesis to manipulate cellular redox conditions, thereby promoting acquisition of a germ cell fate.

For example, the chemical treatment can be in the form of a gas, liquid, or solid, including, but not limited to, a redox-modulatory compound dissolved in a liquid or as a particle present in a liquid. A chemical treatment useful for promoting acquisition of a germ cell fate includes contacting the cell with a potassium iodide solution (KI, 10 mM) for up to 48 hours. Another chemical treatment useful for promoting acquisition of a germ cell fate includes contacting the cell with sodium nitroprusside (SNP, 20 µM), as well as a SNP chemical treatment while under hypoxic atmosphere conditions achieved by administering gases, such nitrogen gas ($N_2$) and or carbon dioxide ($CO_2$), for example to atmospheric levels less than 19.5 percent oxygen. In response to such treatment, the treated cell is thereby cultured with an altered acquisition of germ cell fate.

In another aspect, it is believed that meiosis-specific gene products can alter control of a cell's commitment to entry into meiosis. Thus, methods for contacting the cells with a gene, or genes, conferring functional activity for committing entry of the cell into meiosis are of interest. Such genes useful in the present method include but are not limited to ectopic expression and biological activity of A-type cyclins and/or a single B-type cyclin (CYCB3; 1) are shown to contribute to meiosis-related processes. Other examples of genes useful for promoting transitions into a meiotic cell cycle include ectopic overexpression of TAM (Tardy Asynchronous Meiosis, also known as CYCA1; 2), OSD1 (Omission Of Second Division), TDM (Three-Division Mutant), and SMG7 (Suppressor With Morphogenetic Effects On Genitalia 7). Exemplary candidate sequences are shown in Table 19.

TABLE 19

| Sequence Name | Sequence ID (DNA) | Sequence ID (protein) | Organism |
|---|---|---|---|
| cyca2; 1-1 | 203 | 204 | Arabidopsis thaliana |
| cyca2; 2-1 | 205 | 206 | Arabidopsis thaliana |
| cyca3; 2-2 | 207 | 208 | Arabidopsis thaliana |
| cyca3; 3-1 | 209 | 210 | Arabidopsis thaliana |
| cyca3; 4-1 | 211 | 212 | Arabidopsis thaliana |
| cycb3; 1-1 | 213 | 214 | Arabidopsis thaliana |
| sds-3 | 215 | 216 | Arabidopsis thaliana |
| smg7-1 | 217 | 218 | Arabidopsis thaliana |
| tam-2 | 219 | 220 | Arabidopsis thaliana |
| tdm1-1 | 221 | 222 | Arabidopsis thaliana |
| osd1 | 223 | 224 | Arabidopsis thaliana |
| ZM- Cyclin-A2-1-Like | 225 | 226 | Zea mays |
| ZM- Cyclin-A2-1-Like | 227 | 228 | Zea mays |
| ZM-Cyclin-A1-2-Like | 229 | 230 | Zea mays |
| ZM-Cyclin-A3-3-Like | 231 | 232 | Zea mays |
| ZM-Cyclin-A3-4-Like | 233 | 234 | Zea mays |
| ZM-Cyclin-A3-4-Like | 235 | 236 | Zea mays |
| ZM-Cyclin-A3-4-Like | 237 | 238 | Zea mays |
| ZM-cyclin-B3-1-Like | 239 | 240 | Zea mays |
| ZM-cyclin-B3-1-Like | 241 | 242 | Zea mays |
| ZM-cyclin-B3-1-Like | 243 | 244 | Zea mays |
| ZM-Cyclin-SDS-Like | 245 | 246 | Zea mays |
| ZM-Cyclin-SDS-Like | 247 | 248 | Zea mays |

TABLE 19-continued

| Sequence Name | Sequence ID (DNA) | Sequence ID (protein) | Organism |
|---|---|---|---|
| ZM-smg7-Like | 249 | 250 | Zea mays |
| ZM-smg7-Like | 251 | 252 | Zea mays |
| ZM-OSD1-Like | 253 | 254 | Zea mays |
| ZM-AMEIOTIC1 | 255 | 256 | Zea mays |

As previously reported the regulatory network controlling the transition from mitosis to meiosis in *Schizosaccharomyces pombe* comprises the regulation of Mei2, an RNA binding protein required for conjugation and meiotic entry, Ste11, a transcription activator required for the sexual differentiation, in conjunction with multiple feedback loops involving Pat1, a kinase that keeps cells in mitosis. Given a key role for Mei2 and Ste11 activity in *S. pombe* and that homologs are present in higher plants, such meiosis-specific gene products are also considered useful in the methods of the present disclosure. Providing meiosis-specific gene products to a cell comprises contacting a cell with meiosis-specific proteins and/or meiosis-specific RNA molecules. For example, Meiosis protein mei2 (Mei2), an RNA binding protein essential for the initiation of meiosis antagonizes selective elimination of meiotic messenger RNAs such as the long non-coding RNA (lncRNA), called "meiRNA", transcribed from the sme2 gene. Thus, methods of the present disclosure can provide such a protein, or such an RNA molecule, or preferentially, a combination of the two components, to a cell.

Given that *S. pombe* has been used as a model system, exemplary *Zea mays* sequences as shown in Table 20, including the exemplary mutations of conserved amino acid residues to reduce phosphorylation sites are provided that are useful in the methods of the present disclosure. RNA binding proteins can encode an RNA recognition motif (RRM), with the C-terminal RRM being required for meiosis initiation and may be useful in the methods of the present disclosure. Protein containing RRMs are also of interest. One RRM containing an eight amino acid consensus sequence is RRM-1, also called "RNP-1" (see PFAM motif PF00076); a second RRM containing a six amino acid consensus sequence is RRM-2, also called "RNP-2" (see PFAM motif PF04059) may be useful in the methods of the disclosure. More generally, such proteins can contain an RNA-binding domain or RNA recognition motif.

TABLE 20

| Sequence ID | Species | DNA Seq ID | Protein Seq ID | peptide length | Motif location (a.a. residues) | Motif/ Domain Name |
|---|---|---|---|---|---|---|
| dpzm01g062390 | Zea mays | 257 | 268 | 326 | 105-170 | RRM_1 |
| | | | | | 104-172 | RNA recognition motif |
| | | | | | 69-195 | RNA-binding domain |
| dpzm02g083410 | Zea mays | 258 | 269 | 345 | 107-170 | RRM_1 |
| | | | | | 104-172 | RNA recognition motif |
| | | | | | 103-176 | RNA recognition motif |
| | | | | | 69-197 | RNA-binding domain |
| dpzm03g043550 | Zea mays | 259 | 270 | 664 | 229-284 | RRM_1 |
| | | | | | 95-164; 220-287; 450-535 | RNA recognition motif |
| | | | | | 219-291 | RNA recognition motif |
| | | | | | 448-559 | RRM_2 |
| | | | | | 92-298; 448-552 | RNA-binding domain |
| dpzm04g003160 | Zea mays | 260 | 271 | 361 | 67-131 | RRM_1 |
| | | | | | 66-134 | RNA recognition motif |
| | | | | | 65-138 | RNA recognition motif |
| | | | | | 54-166 | RNA-binding domain |
| dpzm04g029070 | Zea mays | 261 | 272 | 959 | 270-334; 355-419 | RRM_1 |
| | | | | | 269-337; 354-422; 824-900 | RNA recognition motif |
| | | | | | 268-341; 353-421 | RNA recognition motif |
| | | | | | 822-918 | RRM_2 |
| | | | | | 266-421; 822-911 | RNA-binding domain |
| dpzm05g050650 | Zea mays | 262 | 273 | 995 | 270-334; 355-420 | RRM_1 |
| | | | | | 269-337; 354-422; 823-899 | RNA recognition motif |

TABLE 20-continued

| Sequence ID | Species | DNA Seq ID | Protein Seq ID | peptide length | Motif location (a.a. residues) | Motif/Domain Name |
|---|---|---|---|---|---|---|
| dpzm06g013850 | Zea mays | 263 | 274 | 940 | 268-341; 353-426 | RNA recognition motif |
|  |  |  |  |  | 821-917 | RRM_2 |
|  |  |  |  |  | 266-433; 821-910 | RNA-binding domain |
|  |  |  |  |  | 275-337 | RRM_1 |
|  |  |  |  |  | 274-342; 359-427; 784-860 | RNA recognition motif |
|  |  |  |  |  | 273-346; 358-431 | RNA recognition motif |
|  |  |  |  |  | 782-878 | RRM_2 |
|  |  |  |  |  | 375-419 | RRM_5 |
|  |  |  |  |  | 272-438; 782-871 | RNA-binding domain |
| dpzm06g015820 | Zea mays | 264 | 275 | 316 | 253-315 | RRM_2 |
|  |  |  |  |  | 253-315 | RNA-binding domain |
| dpzm06g015830 | Zea mays | 265 | 276 | 823 | 176-240; 261-326 | RRM_1 |
|  |  |  |  |  | 175-243; 260-328; 661-737 | RNA recognition motif |
|  |  |  |  |  | 174-247; 259-332 | RNA recognition motif |
|  |  |  |  |  | 659-755 | RRM_2 |
|  |  |  |  |  | 172-339; 659-748 | RNA-binding domain |
| dpzm09g012200 | Zea mays | 266 | 277 | 847 | 200-264; 285-350 | RRM_1 |
|  |  |  |  |  | 199-267; 284-352 | RNA recognition motif |
|  |  |  |  |  | 198-271; 283-356 | RNA recognition motif |
|  |  |  |  |  | 683-779 | RRM_2 |
|  |  |  |  |  | 196-363 | RNA-binding domain |
| dpzm10g029750 | Zea mays | 267 | 278 | 952 | 243-307; 329-390 | RRM_1 |
|  |  |  |  |  | 242-310; 326-396 | RNA recognition motif |
|  |  |  |  |  | 241-314; 325-398 | RNA recognition motif |
|  |  |  |  |  | 772-868 | RRM_2 |
|  |  |  |  |  | 235-405; 772-861 | RNA-binding domain |

The activity of the Mei2 protein is inactivated by the PAT1 kinase-mediated phosphorylation leading to Mei2 degradation by the proteasome. It was previously demonstrated that mutants of Mei2 that cannot be phosphorylated, and thus were not degraded, ectopically initiated meiosis. Such mutant alleles had substitutions comprising serine 438 changed to proline, tryptophan 442 changed to arginine, and arginine 524 change to alanine, or arginine 524 changed to serine. Thus, providing a modified form of a meiosis-specific proteins with reduced phosphorylation sites and therefore improved stability and ability to initiate meiosis to a cell is of interest for use in the methods of the present disclosure. An exemplary sequence is provided for a maize optimized Z. mays MEI2-like homolog, dpzm10g029750 (SEQ ID NO: 267), here with a conserved serine at position 573 substituted to proline to abolish a target site characteristic for many protein-serine/threonine kinases (SEQ ID NO: 279; SEQ ID NO: 280).

Sequences containing other amino acid substitutions resulting in the loss of kinase target sites required for proteasome-mediated degradation of a plant MIE2-like protein can also be used in the methods of the present disclosure. For example, similar modifications to the other peptides provided in Table 20 are considered useful in the methods of the present disclosure.

For methods providing an RNA binding protein that is a meiosis-specific protein, providing a meiosis-specific RNA molecule would be useful in the methods of the present disclosure. For example, Mei2 antagonizes selective elimination of meiotic messenger RNAs such as the long non-coding RNA (lncRNA), called "meiRNA", transcribed from the sme2 gene. Using the methods of the present disclosure that provide meiRNA to a cell will promote, alone or in combination with a MIE2-like protein, improved induction of a meiosis cell cycle program.

Given a key role for other gene activities during meiosis in S. pombe, such as the Ste11 transcription factor that is a critical regulator of sexual development, additional meiosis gene products are provided as proteins useful in the methods of the present disclosure as shown in Table 21. Co-expressing a gene product as provided in Table 19, 20, or 21 alone, or combinations thereof, can be useful for controlling a cell's commitment to entry into meiosis.

TABLE 21

Plant meiotic gene product

| | *Arabidopsis thaliana* | | SEQ ID NO: | |
|---|---|---|---|---|
| Count | candidate gene | *Zea mays* gene | DNA | Protein |
| 1 | DMC1 | dpzm03g034840.1.1 | 281 | 299 |
| 2 | PTD | dpzm08g021210.1.1 | 282 | 300 |
| 3 | PHS1 | dpzm09g018240.1.1 | 283 | 301 |
| 4 | SWI1 (aka DYAD) | dpzm01g055280.1.1 | 284 | 302 |
| 5 | MER3 (aka RCK) | dpzm04g037550.1.1 | 285 | 303 |
| 6 | PRD3 | dpzm01g001030.1.1 | 286 | 304 |
| 7 | DIF1 (aka SYN1; REC8) | dpzm00g010100.1.1 | 287 | 305 |
| 8 | ASY1 | dpzm02g061410.1.1 | 288 | 306 |
| 9 | MND1 | dpzm02g048810.1.1 | 289 | 307 |
| 10 | SPO11-2 | dpzm04g014250.1.1 | 290 | 308 |
| 11 | MUS81 | dpzm03g039530.1.1 | 291 | 309 |
| 12 | RAD51 | dpzm07g049680.1.1 | 292 | 310 |
| 13 | ZYP1 | dpzm10g033590.1.1 | 293 | 311 |
| 14 | RMI1 | dpzm02g028550.1.1 | 294 | 312 |
| 15 | DUET (aka MMD1) | dpzm05g007690.1.1 | 295 | 313 |
| 16 | PS1 | dpzm02g043520.1.1 | 296 | 314 |
| 17 | SPO11-1 | dpzm05g005660.1.1 | 297 | 315 |
| 18 | COM1 (aka GR1) | dpzm09g029340.1.1 | 298 | 316 |

After a F1 hybrid embryo is isolated, mitotic cell cycle activation is initiated using methods described in Example 3 and 5, and during this process the cells can be exposed to redox-modulatory conditions described above, that can simultaneously include contacting the cells with a gene product, or gene products, useful for committing entry of the cell into meiosis (see Example 14), thereby promoting entry into a meiotic cell cycle program to acquire a germ cell fate. After incubation using resting medium under such conditions, an induced embryo containing a meiotically recombined genome that is equivalent to a new haploid gamete is individually transferred onto regeneration medium (289Q).

Preferentially, meiotically recombinant cells generated by this method can be separated using vortexing to separate the germinating embryos. For example, at twenty (20) days post *Agrobacterium tumefaciens* infection, the developing tissue is transferred to a sterile 50 ml centrifuge tube containing approximately twenty (20) mL of liquid, vortexed, and the tissue is transferred onto regeneration medium (289Q). The embryos are cultured under dark conditions until shoot and root formation is initiated and then transferred under light conditions for plantlet regeneration.

In one aspect, dissected haploid embryos can be transferred to resting regeneration medium (605J or 289Q medium) with a chromosome doubling (or mitotic inhibitor) agent, for example colchicine at concentrations of 0.1-1.0 g/ml to cause mitotic arrest of dividing cells at metaphase by interfering with microtubule organization, for example for a 24-hour period and then transferring to a regeneration resting medium (e.g. 605J, 289Q medium, or preferentially 605T medium) without a chromosome doubling agent followed by incubation at 28° C. under dark conditions. After three (3) to seven (7) days, the embryos are transferred to maturation medium (289Q medium) without selection.

In another aspect, meiotically recombinant haploid cells can be isolated and two such cells can be fused either electrically or chemically and such cultured products have been shown to develop into fertile plants.

After completing such a chromosome doubling treatment or a cell fusion treatment, a sub-cultured tissue is transferred to a light culture room at 26° C. until healthy plantlets with good roots develop. Approximately 7-14 days later, plantlets are transferred to soil and typically grown for one week in a growth chamber, subsequently grown an additional 1-2 weeks in the greenhouse, and then transplanted to soil and grown to maturity.

After a regenerated plant further develops, a leaf tissue sample can be collected per plant, DNA is isolated, and a diagnostic PCR-based assay is performed to detect presence/absence of a T-DNA, and or any related plasmid DNA sequence, and/or to compute genomic estimated breeding values (GEBVs) as described in Example 6.

The creation of novel genetic entities is achieved by ectopically activating meiotic recombination before, during, or after initiation of mitosis, thus providing a novel approach for performing "in vitro nursery" breeding activities. In contrast to the results shown in Example 5, wherein the resulting somatic embryos are clonal somatic embryos, here the method produces non-clonal gametic cells used to generate fertile plants useful for plant breeding.

Entry into meiosis comprises two parts, i) exit from the mitotic cell cycle and, ii) induction of the alternate meiotic cell cycle program, here the methods of the present disclosure promote entry into a meiotic cell cycle program, for example in response to mitotic cell cycle activity as shown in Example 5. Methods of stimulating entry into a meiotic cell cycle program comprising cell treatments that increase hypoxia and or lower cellular hydrogen peroxide levels, using either environmental and or chemical methods, and cell treatments providing activity of a gene product, or gene products, are expected to be useful for committing entry of the cell into meiosis and it is furthermore expected that combinations of these methods can result in greater efficacy.

Likewise, it is expected that simultaneously providing two or more gene products useful for inducing a meiotic cell cycle program, including but not limited to proteins described in Tables 19, 20 and or 21, can result in greater efficacy for inducing a meiotic cell cycle program, thereby improving the productivity of the methods disclosed herein of obtaining embryogenic cells with genomes produced by meiotic recombination.

Thus, it is expected that a treated embryo explant, such as an F1 embryo resultant from biparental fertilization between two inbred plants, can be cultured to produce embryogenic cells having genomes that are each the product of meiotic recombination. After using the methods disclosed herein, it is expected an embryogenic cell can produce a plant with a genome comprising a novel genetic entity that is useful for plant breeding.

Example 14: Transiently Expressing Meiotic Genes for In Vitro Plant Breeding

The methods of stimulating entry into a meiotic cell cycle program described in Example 13 comprise providing the activity of a gene product, or gene products, useful for committing entry of the cell into meiosis.

Methods for transiently expressing such meiotic genes are now described. Specifically, in this experiment, an *Agrobacterium* with a plasmid as shown in Table 16 can be used, for example RV020636 (SEQ ID NO: 186), to stimulate mitotic activity and embryogenesis in a plant cell. Here a second *Agrobacterium* with a plasmid comprising an expression cassette with a polynucleotide encoding a "meiosis induction" protein is used. More specifically this expression cassette can have one or more polynucleotide sequences encoding the gene products as described in Table 19, 20 and/or 21.

In an aspect, the meiosis induction expression cassette can be designed for *Agrobacterium*-mediated protein expression, wherein the polynucleotide does not integrate into the genome of the plant and the plant does not contain vector (plasmid) backbone.

One method includes "beyond the border" plasmid designs.

Another method uses *Agrobacterium*-mediated transient protein delivery into a plant cell and is used here specifically for delivery into a plant cell of meiosis-specific gene products as described in Example 13. Here, this method comprises using *Agrobacterium* to achieve both synthesis and delivery of polypeptides described in Table 19, 20, and/or 21.

Functional delivery of a protein is accomplished, for example β-glucuronidase (GUS), by using a polynucleotide encoding virF that was operably linked to a polynucleotide encoding the GUS protein. A virF-gusA (also virF-uidA) fusion construct was placed on a replicon without T-DNA borders that replicates in *Agrobacterium tumefaciens*. In the replicon the polynucleotides encoding VirF and GUS were operably linked. This construction was placed under the control of the virF promoter and, consequently, was regulated by the virA/virG genes as part of the phenolic-induced vir regulon. The replicon was introduced into the wild-type octopine strain *A. tumefaciens* A348. Expression of the virF-gusA fusion construct in *Agrobacterium* was partially independent of acetosyringone (AS) induction. However, even with the incomplete AS dependence, induction of VirF-GUS expression by AS was increased significantly in *Agrobacterium*, as measured by GUS fluorometric analyses.

Using the method of the present disclosure, a first *Agrobacterium* strain with plasmid RV020636 as described in Example 5 is used. Upon infection, this plasmid provides a T-DNA to a first plant cell that allows the first plant cell to express the WUS protein. The WUS protein can move in a non-cell autonomous manner, thereby the protein is provided to a second plant cell. In the present method, the second plant cell is not exposed to the presence of a T-DNA.

Once a second plant cell is contacted with a WUS protein, the second plant cell is then simultaneously contacted with a meiosis-specific gene product, or products, resulting from co-infection with a second *Agrobacterium* strain. Here, the second *Agrobacterium* strain provides translocation into the second plant cell by expressing a translational fusion protein comprising a Vir translocation peptide domain fused to a peptide described in Table 19, 20, and/or 21. In the present method, a polynucleotide encoding the translational fusion protein, or proteins, is operably linked to the virF promoter and, consequently, is regulated by the virA/virG genes as part of the phenolic-induced vir regulon. Here, a virF-meiosis induction replicon introduced into an *A. tumefaciens* strain, for example AGL1 THY- without T-DNA borders, which is used to transiently express and ectopically deliver the meiosis induction protein(s) into a plant cell.

Specifically, co-infection using two *Agrobacterium* strains as described above provides a combination of i) mitotic cell cycle activity and ii) induction of an alternate meiotic cell cycle program to result in the development of haploid, embryogenic cells having genomes produced by meiotic recombination.

In the methods of the present disclosure, an immature F1 hybrid embryo is an exemplary explant used for the following treatment. Using the two *Agrobacterium* strains as described above, the two different strains are combined in a mixture, for example a mixture with a first *Agrobacterium* strain encoding the WUS protein expression cassette (Agro1) and a second *Agrobacterium* strain encoding the meiosis induction expression cassette (Agro2). Ratios of Agro1:Agro2 can be 95:5, or 90:10, and other ratios. For treating a cell of the F1 hybrid diploid embryo, the bacterial/plant cell ratio of approximately 1000:1 is used.

After 24 hours, the plant cells are washed, and the medium replaced with medium containing timentin to kill *Agrobacterium*. Preferentially, the cells can be cultured using the environmental and or chemical treatments as described in Example 13 before, during, or after *Agrobacterium* co-infection. Following co-cultivation each diploid embryo exhibiting a somatic embryogenesis response is cultured and plantlets are regenerated as described in Example 13.

The transient expression method described herein provides a method for simultaneous co-infection of a plant explant, for example an immature F1 hybrid embryo. Such methods described herein are useful for both precociously expressing meiotic genes and for transporting such ectopic activity into a plant cell, such as the protein activities described in Example 13. It is also expected that changing the redox potential of cells can further improve the induction of a meiotic cell cycle program in response to the co-infection process described. Thus, it is expected that this method enables capabilities for creating plants derived from somatic embryos that are F2 generation equivalents, thereby providing a novel method useful for "in vitro nursery" breeding activities.

Example 15: Generating Wheat Clonal Doubled Haploids Using Homology-Directed Repair (HDR)

The following experiments demonstrate using a gene targeting system to facilitate directional targeting of desired genes and nucleotide sequences into corresponding homologous recombination sites on each of three paired (homologous) sets of chromosomes of a wheat (*Triticum aestivum*) haploid cell.

Immature wheat haploid embryos are created, for example using wide hybridization methods. Expression of an AP2 domain transcription factor can induce haploid induction. For such AP2 domain transcription factor methods, *Agrobacterium*-mediated stable plant transformation is employed. For example, the ODP2 nucleotide sequence introduced into the plant is under the control of a tissue specific promoter that is active in a haploid cell or tissue or a promoter that is active during male or female gamete development. Alternatively, the ODP2 nucleotide sequence is under the control of an inducible promoter and the application of the inducer allows expression of the ODP2 sequence therein. Alternatively, the promoter used can be both inducible and tissue-preferred. For example, the promoter can be both haploid-tissue specific and inducible.

Preferentially, methods of the present disclosure can further use site-specific recombination systems in combination with such an ODP2 expression cassette operably linked to such promoters (i.e., constitutive promoters, tissue-specific promoters, or inducible promoters). For example, by using a first lox site and a second lox site flanking the ODP2 expression cassette, wherein the promoter is operably linked to a polynucleotide encoding the ODP2 polypeptide to be active during either male or female gamete development.

A promoter expressed in the egg cell of the plant is useful for regulating ODP2 expression to promote maternal haploid induction, resulting in a percentage of the progeny to be haploid having half the number of chromosomes compared to the parent. For example, using exemplary promoters including but not limited to AT-DD5, AT-DD31, AT-DD65, or more preferentially the ZM-DD45 promoter. Additionally, a *Zea mays* egg cell promoter operably linked to a polynucleotide encoding the ODP2 protein and a 3' UTR from a *Zea mays* egg cell gene can be used.

The methods of the present disclosure further comprise transforming a F1 hybrid wheat embryo with *Agrobacterium* strain LBA4404 THY—(See U.S. Pat. No. 8,334,429 incorporated herein by reference in its entirety) as described in Example 3. Transformation of a F1 hybrid wheat embryo is performed to create a stable, hemizygous transgenic plant containing the ODP2 expression cassette operably linked to an egg cell promoter. Upon transitioning to the reproductive phase, the plant self-fertilizes, and maternal haploid embryos can be collected.

Clonal propagation of clonal doubled haploid plants in combination with gene targeting is performed by then transforming a maternal haploid embryo using *Agrobacterium* transformation methods as described above. In the current method, a mixture with another *Agrobacterium*, here containing a gene targeting plasmid with a T-DNA comprised of multiple "Traits" (for example a zinc finger nuclease, a donor excision template encoding a trait gene, and an anthocyanin color marker; see Table 9) can be used.

*Agrobacterium* strains are mixed at a ratio of 95% Trait-containing plasmid (for example, PHP90670 (SEQ ID NO: 192) to 5% WUS-containing plasmid (RV020636 (SEQ ID NO: 186). When haploid embryos are co-infected with this *Agrobacterium* mixture, transgenic T0 plants containing only a single copy of the "Trait" T-DNA (PHP90670) with no integration of the WUS-containing T-DNA (RV020636) are regenerated. Upon expression of the Trait T-DNA (PHP90670), activity of the enhanced zinc finger nuclease (EXZFN) will excise the donor template encoded in the "Trait" T-DNA, thereby allowing homology directed repair and stable transgene integration at each targeted double strand break site.

Transformed cells with excised donor templates can be detected using morphological detection of anthocyanins expressed by a functional B-Peru gene resulting from excision of the donor template, thereby allowing B-Peru gene regulation from the ZmGlob1 regulatory sequence. Stable transgenic plants are identified using positive selection, for example by identifying plants with herbicide resistance to haloxyfop.

It is expected that culturing such plants in the presence of a chromosome doubling agent as described in Example 6 will facilitate chromosome doubling and diploidization of the stable transgenic doubled plants.

It is expected that each hemizygous, single copy plant with herbicide tolerance will have a "Trait" gene inserted at a targeted site in the genome and the remnant "Trait" T-DNA comprising the repaired T-DNA sequence inserted at a random position in the genome.

Within a doubled haploid clone set possessing the "Trait" gene inserted at targeted sites, selecting clonal individuals for cross-fertilization is performed, thereby creating seed of this cross to be propagated. Some progeny can be expected to be wild type at loci segregating for each random T-DNA insertion site comprising the repaired "Trait" T-DNA sequence with also inheritance of alleles from both parental gametes with a successful gene targeting event at the targeted transgene integration site. Selection of an individual without the repaired "Trait" T-DNA, while possessing alleles with a successful gene targeting event at the targeted transgene integration sites can be self-fertilized. Further propagation of such plants will then segregate as clonal doubled haploids with homozygous copies of the "Trait" gene at each homologous chromosome's target site.

It is expected that methods using an expression cassette encoding CRE recombinase as a component in the gene targeting construct, such as RV036376 (SEQ ID NO: 317), can be used for excising the ODP2 expression cassette when a first lox site and a second lox site is flanking the ODP2 expression cassette. In this manner, the resulting doubled haploid plants with homozygous copies of the "Trait" gene at each homologous chromosome's target site are regenerated without the random T-DNA insertion site comprising the repaired "Trait" T-DNA sequence and furthermore are lacking the ODP2 expression cassette that was required for conferring maternal haploid induction.

It is expected that the above methods described for maternal haploid induction in combination with propagating clonal doubled haploid progeny possessing gene targeting events can be used with paternal haploid induction systems. For example, an ODP2 expression cassette operably linked to a promoter that is active during microspore development can be used, such as the maize PG47 promoter for treatment of a cell derived from a paternal gamete using methods as described in Example 12. In the present disclosure, *Agrobacterium* strains are mixed at a ratio of 95% Trait-containing plasmid (for example, PHP90670 (SEQ ID NO: 192)) to 5% WUS-containing plasmid (RV020636 (SEQ ID NO: 186)) to create clonal doubled haploids with homozygous copies of the "Trait" gene at each homologous chromosome's target site.

Preferentially, use of a first lox site and a second lox site flanking the ODP2 expression cassette and the presence of an expression cassette encoding the CRE recombinase protein can be used for excising the ODP2 expression cassette that was required for conferring paternal haploid induction.

The methods of the present disclosure are an improvement to the current state of the art and accelerate trait introgression using wheat haploid induction breeding methods, thus, enabling forward breeding capabilities for site-directed transgene integration in wheat doubled haploids without the need for backcrossing-mediated trait introgression.

Example 16: Using Viral Enhancers with the Maize PLTP Promoter to Drive WUS2 Expression Enhances Recovery of Non-Transgenic Somatic Embryos and Plants in Wheat a) Experiment 1. Freshly harvested wheat immature grains were sterilized with 50% bleach and 0.1% Tween-20 for thirty (30) minutes under vacuum and then rinsed with sterile water three times. *Agrobacterium* strain LBA4404 THY-containing the virulence plasmid PHP71539 (SEQ ID NO: 184) was used in all treatments. In a (control) first treatment, an *Agrobacterium* containing PHP71539 (SEQ ID NO: 184) (with no T-DNA) was adjusted to an OD of 1.0 (600 nm) in liquid 716B medium, and immature wheat embryos were added to the *Agrobacterium* suspension for twenty (20) minutes at room temperature (25° C.). In a second treatment, a second *Agrobacterium* containing both PHP71539 (SEQ ID NO: 184) and PHP88158 (SEQ ID NO: 182) (RB+3XENH::ZM-PLTP PRO:: ZM-WUS2::IN2-1 TERM+NOS PRO::CRC::SB-GKAF TERM+LB) was mixed with the *Agrobacterium* containing only PHP71539 (SEQ ID NO: 184), both *Agrobacterium* strain suspensions first being adjusted to an OD of 1.0 (600 nm) and then mixed at a ratio of 90% PHP71539 alone (SEQ ID NO: 184) to 10% PHP71539 (SEQ ID NO: 184)+PHP88158 (SEQ ID NO: 182). After a 15-minute liquid infection treatment, the immature embryos were removed from the liquid medium and transferred onto solid 606 medium and oriented scutellum-side up for culture at 21° C. in the dark overnight. The embryos were transferred again onto fresh resting medium (606) for ten (10) days, then onto regeneration medium 689E with selection in the dark. The tissue was then moved onto regeneration medium 689E with selection in the light and then the number of plants produced was tabulated.

In the (control) first treatment, fifty-six (56) immature embryos of Spring wheat variety SBC0456D were infected with the *Agrobacterium*. Eight (8) of the immature embryos produced a single plant from a scutellum-derived somatic embryo, six (6) immature embryos produced two (2) plants each, and seven (7) immature embryos produced 3 or more plants per starting immature embryo, for a total production of ≥41 plants (all being confirmed by PCR to be non-transgenic). In the second treatment, a total of sixty-nine (69) immature embryos were infected. Twenty (20) immature embryos each produced a single scutellum-derived plant, twenty-two (22) immature embryos each produced two (2) plants, and over twenty-seven (27) immature embryos each produced three (3) or more plants, for a total production of ≥144 plants (all being confirmed by PCR to be non-transgenic). The second treatment provided a substantial improvement in micro-propagation production of non-transgenic plants that are then ready for transfer to the greenhouse. The final molecular analysis confirmed that the plants generated by this method were non-transgenic, containing no T-DNA with the morphogenic expression cassette(s) and no *Agrobacterium* plasmid backbone sequences (present in both plasmids) being integrated.

Finally, the promoter used to express the ZM-WUS2 gene can be switched from the ZM-PLTP promoter to the barley LTP2 promoter. Both plant promoters are preceded by three promoter enhancer elements from three separate viruses, the Figwort Mosaic Virus, the Peanut Chlorotic Streak Virus, and the *Mirabilis* Mosaic Virus. When this new promoter is used, it is expected that the stimulation of non-transgenic somatic embryos from the scutellum of the immature embryos will be further enhanced resulting in greater numbers of non-transgenic plants being produced.

b) Experiment 2. Wheat immature embryos were harvested, transformed using *Agrobacterium*, and cultured, as described above in Experiment 1 of this Example 16. Results for the four treatments are summarized in FIGS. 3-6.

In the (control) first treatment (FIG. 3), twenty-six (26) immature embryos of Spring wheat variety SBC0456D were infected with the *Agrobacterium* containing the virulence plasmid PHP71539 (SEQ ID NO: 184), with a total of nineteen (19) producing no response. Of the remaining seven (7) immature embryos, three (3) each produced one (1) R0 plant, three (3) each produced two (2) R0 plants, and one (1) immature embryo produced four (4) R0 plants, for a total production of seven (7) R0 plants (all being confirmed by PCR to be non-transgenic). Thus, in the (control) first treatment, the R0 propagation frequency was 27% (7 R0 plants/26 embryos).

In the second treatment (FIG. 4), where the second *Agrobacterium* containing both PHP71539 (SEQ ID NO: 184) and PHP88158 (SEQ ID NO: 182) (RB+3XENH::ZM-PLTP PRO::ZM-WUS2::IN2-1 TERM+NOS PRO::CRC::SB-GKAF TERM+LB) was mixed with the *Agrobacterium* containing only PHP71539 (SEQ ID NO: 184), a total of thirty-five (35) wheat immature embryos were infected. However, in contrast to the control treatment in which the majority of the immature embryos showed no response, delivery of the WUS2-containing T-DNA (PHP88158 (SEQ ID NO: 182)) resulted in only two (2) of thirty-five (35) embryos being non-responsive (FIG. 4) and producing no R0 plants. For this treatment, three (3) immature embryos produced a single (1) R0 plant, while one (1), five (5) or four (4) immature embryos produced two (2), three (3), or four (4) R0 plants/embryo respectively. In addition, a total of fifteen (15) if the thirty-five (35) infected immature embryos produced between six (6) and twelve (12) R0 plants per starting embryo. For this treatment, a total of one hundred eighty-two (182) R0 plants were produced for a R0 propagation frequency of 520% (182 R0 plants/35 embryos).

In a third wheat treatment (FIG. 5), where the second *Agrobacterium* containing both PHP71539 (SEQ ID NO: 184) and PHP25340 (SEQ ID NO: 193) (RB+UBI PRO::CFP::PINII TERM+3XENH::ZM-PLTP PRO::ZM-ODP2::IN2-1 TERM+LB) was mixed with the *Agrobacterium* containing only PHP71539 (SEQ ID NO: 184), a total of thirty-eight (38) wheat immature embryos were infected. Twenty-two (22) immature embryos produced no response (zero (0) R0 shoots were produced). Of the remaining sixteen (16) immature embryos, five (5) embryos each produced a single plant, four (4) embryos each produced two (2) plants, four (4) embryos each produced three (3) plants, and each of three (3) single embryos produced either four (4), six (6), or eight (8) plants/embryo. Thus, a total of forty-three (43) R0 plants were produced from total of thirty-eight (38) immature embryos treated for a R0 propagation frequency of 113% (43 R0 plants/38 embryos).

Figure 6:
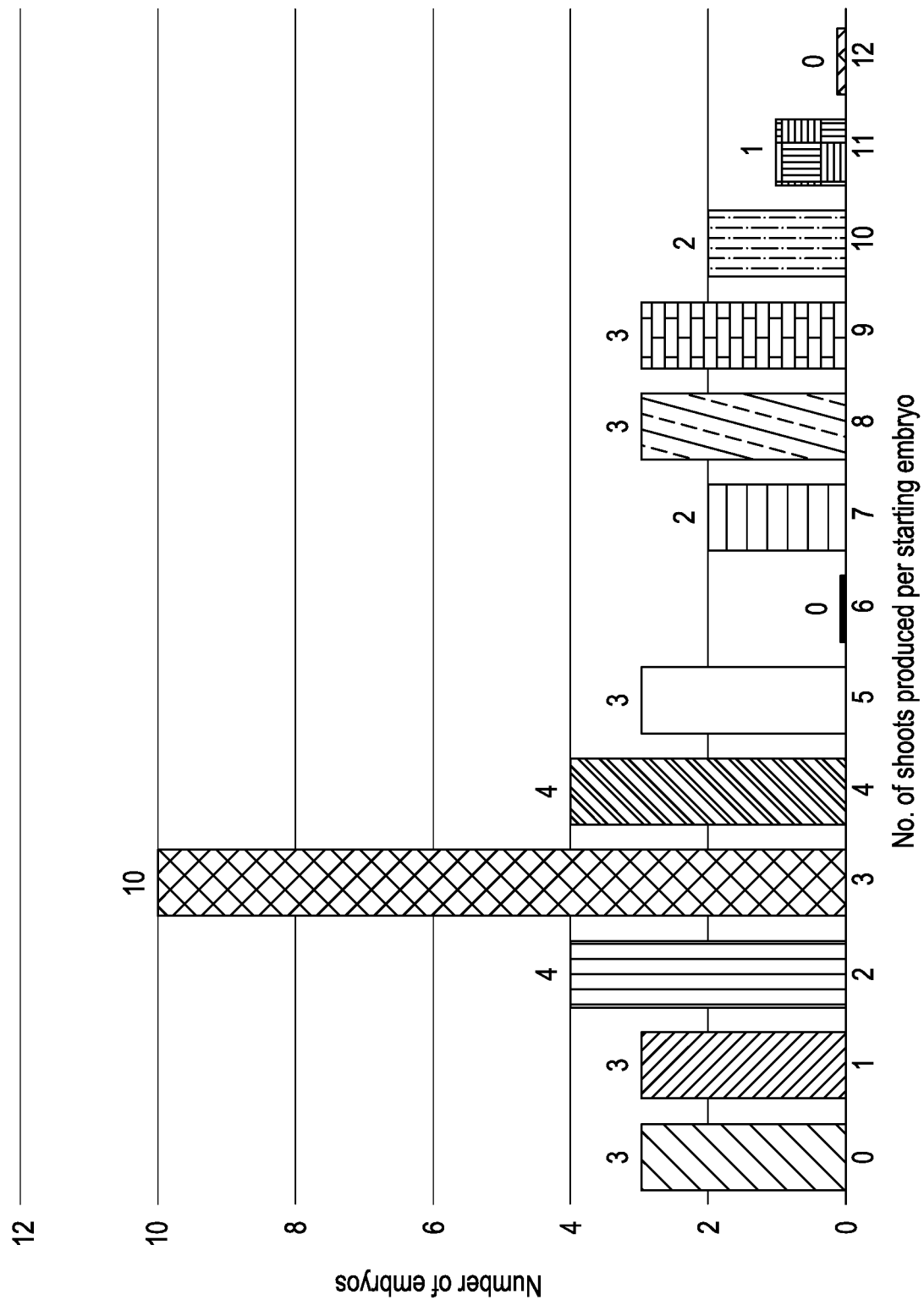
FIG. 6 shows the number of wild-type wheat R0 plants recovered (x axis) per starting embryo (y axis) after *Agrobacterium* infection with 3XENH::PLTP::WUS2+PLTP::ODP2. A total of 38 immature embryos were infected with the *Agrobacterium* with a cumulative production of 168 shoots resulting in a 442% propagation frequency.
Figure 7:
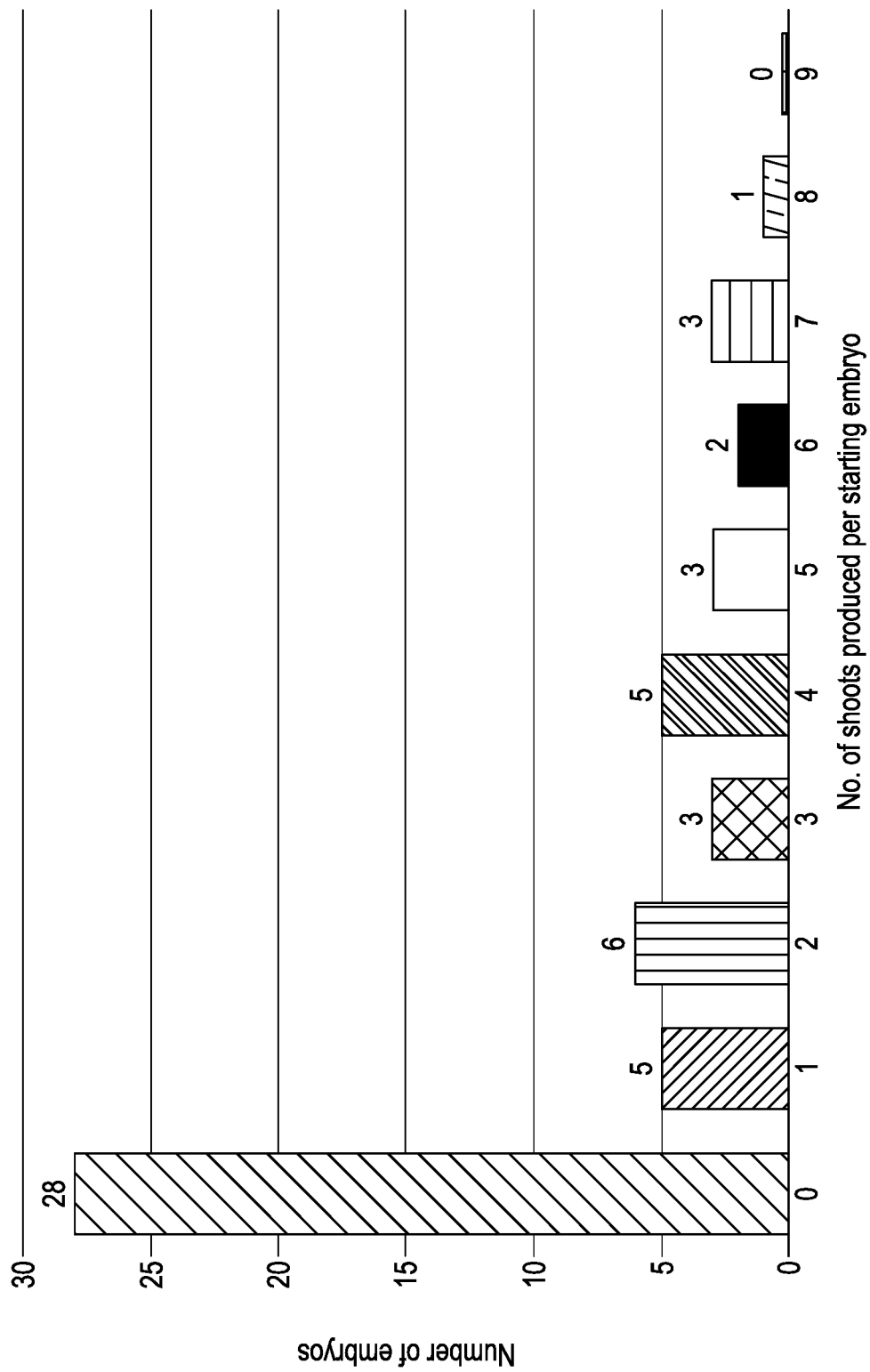
FIG. 7 shows the number of wild-type sorghum R0 plants recovered (x axis) per starting embryo (y axis) after *Agrobacterium* infection with no T-DNA. A total of 56 immature embryos were infected with the *Agrobacterium* with a cumulative production of 102 shoots resulting in a 182% propagation frequency.

In the final treatment for wheat (FIG. 6), where the second *Agrobacterium* containing both PHP71539 (SEQ ID NO: 184) and PHP91539 (SEQ ID NO: 194) (RB+3XENH::ZM-PLTP PRO::ZM-WUS2::IN2-1 TERM+ZM-PLTP1 PRO::ZM-ODP2::OS-T28 TERM+NOS PRO::CRC::SB-GKAF TERM+LB) was mixed with the *Agrobacterium* containing only PHP71539 (SEQ ID NO: 184) the R0 plant propagation rate was again greatly simulated (see FIG. 6). In this treatment, a total of thirty-eight (38) wheat immature embryos were treated and only three (3) immature embryos produced no (0) R0 plants. Three (3) embryos each produced one (1) R0 plant, the remaining thirty-two (32) immature embryos each produced multiple R0 plants/immature embryo with the response ranging from two (2) plants/embryo to eleven (11) plants/embryo. In this treatment, the R0 plant propagation frequency was 442% (168 R0 plants/38 embryos).

For all three treatments where either ODP2, WUS2, or ODP2/WUS2 were introduced, a substantial increase in the total frequency of R0 plants produced as a function of starting embryo number was observed in wheat—when compared to the control. The substantial improvement in R0 plant propagation observed in all three morphogenic gene treatments is summarized in terms of total R0 propagation frequency (relative to the starting number of immature embryos) in Table 22 and is presented as the fold-increase relative to the control treatment in Table 23. Table 22 shows the R0 propagation frequency (%) after *Agrobacterium* infection harboring no T-DNA (SEQ ID NO: 184), or a T-DNA containing either 3XENH::PLTP::ODP2 (SEQ ID NO: 193), 3XENH::PLTP::WUS2 (SEQ ID NO: 182), or 3XENH::PLTP::WUS2 plus PLTP::ODP2 (SEQ ID NO: 194). Table 23 shows the fold-increase in R0 propagation frequency (%) after *Agrobacterium* infection harboring a T-DNA containing either PLTP::ODP2 (ODP2), 3XENH::PLTP::WUS2 (WUS), or 3XENH::PLTP::WUS2 plus PLT- P::ODP2 (WUS/ODP2)—relative to the control treatment where the *Agrobacterium* contained no T-DNA (control).

TABLE 22

| Crop | R0 Propagation (%) | | | |
| --- | --- | --- | --- | --- |
| | No T-DNA (SEQ ID NO: 184) | ODP2 (SEQ ID NO: 193) | WUS (SEQ ID NO: 182) | WUS/ODP2 (SEQ ID NO: 194) |
| Maize | 26 | 30 | 154 | 218 |
| Sorghum | 182 | 249 | 312 | 329 |
| Wheat | 27 | 113 | 520 | 342 |

TABLE 23

| Crop | Fold-increase in R0 Propagation Frequency % (relative to control treatment)* | | |
| --- | --- | --- | --- |
| | ODP2 (SEQ ID NO: 193) | WUS (SEQ ID NO: 182) | WUS/ODP2 (SEQ ID NO: 194) |
| Maize | 1.1 | 5.9 | 8.4 |
| Sorghum | 1.4 | 1.7 | 1.8 |
| Wheat | 4.2 | 19.3 | 12.7 |

*Relative to control treatment

In this wheat experiment, all the R0 plants from the (control) first treatment (7 total) and third treatment (43 total), and a subset of plants from the second and final treatments (57 each of the second treatment and final treatment) were sampled for qPCR analysis, to determine the copy number of sequences internal to the T-DNA of the second *Agrobacterium*, specifically tested for copy number of two synthetic PCR-analytical sequences (PSB1 and PSA2) in addition to the ZM-WUS2/IN2-1 junction, and the T-DNA LEFT BORDER or copy number of VIRG, a sequence found only in the *Agrobacterium* plasmid backbone for both the first and second *Agrobacterium* strains. Out of one hundred and sixty-four (164) R0 plants analyzed, only one (1) had a positive band for WUS2, which was likely a false-positive since the other three qPCR markers for the T-DNA were negative. The remaining one hundred sixty-three (163) plants analyzed were determined to contain no T-DNA and no *Agrobacterium* plasmid backbone sequences (with the helper plasmid backbone (SEQ ID NO: 184) having been present in both the first and second *Agrobacterium*). After confirming these R0 plants with vigorous shoots and roots were transgene-free, they are then ready for transfer to the greenhouse.

Example 17: Using Viral Enhancers with the Maize PLTP Promoter to Drive WUS2 Expression Enhances Recovery of Non-Transgenic Somatic Embryos and Plants in Sorghum a) Experiment 1. Freshly harvested sorghum immature grains were sterilized with 50% bleach and 0.1% Tween-20 for thirty (30) minutes under vacuum and then rinsed with sterile water three (3) times. *Agrobacterium* strain LBA4404 THY-containing the virulence plasmid PHP71539 (SEQ ID NO: 184) was used in all treatments. In a (control) first treatment, an *Agrobacterium* containing PHP71539 (SEQ ID NO: 184) (with no T-DNA) was adjusted to an OD of 0.4 (550 nm) in liquid 700 A medium, and immature sorghum embryos were added to the *Agrobacterium* suspension for 15 minutes at room temperature (25° C.). In the second treatment, a second *Agrobacterium* containing both PHP71539 (SEQ ID NO: 184) and PHP88158 (SEQ ID NO: 182) (RB+3XENH::ZM-PLTP PRO::ZM-WUS2:: IN2-1 TERM+NOS PRO::CRC::SB-GKAF TERM+ LB) was mixed with the *Agrobacterium* containing only PHP71539 (SEQ ID NO: 184), both *Agrobacterium* strain suspensions first being adjusted to an OD of 0.4 (550 nm) and then mixed at a ratio of 90% PHP71539 alone (SEQ ID NO: 184) to 10% PHP71539 (SEQ ID NO: 184)+PHP88158 (SEQ ID NO: 182). After the 15-minute liquid infection treatment, the immature embryos were removed from the liquid medium and transferred onto solid medium 562V and oriented scutellum-side up for culture at 21° C. in the dark overnight.

The embryos were subjected to the following sequential steps after infection: (1) co-cultivation: embryos were cultured on PHI-T medium following infection for three (3) days at 25° C. in the dark; (2) resting: embryos were cultured on PHI-T medium plus 100 mg/l carbenicillin for four (4) days at 28° C. in the dark; (3) selection: embryos were cultured on PHI-U medium for two (2) weeks, followed by culture on PHI-V medium for the remainder of the selection process at 28° C. in the dark, using subculture intervals of two (2) to three (3) weeks; and (4) regeneration: callus was cultured on PHI-X medium for two (2) to three (3) week in the dark to stimulate shoot development, followed by culture for one (1) week under conditions of sixteen (16) hours light (40-120 μE m−2 s−1) and eight (8) hours dark at 25° C., and a final subculture on PHI-Z medium for two (2) to three (3) weeks under lights (sixteen (16) hours, 40-120 μE m−2 s−1) to stimulate root growth. Regenerated plantlets were tabulated and are now ready to be transplanted into soil and grown in the greenhouse.

In the (control) first treatment, seventy-three (73) immature embryos of sorghum variety Tx430 were infected with the *Agrobacterium* containing the virulence plasmid PHP71539 (SEQ ID NO: 184) (with no T-DNA). The treated immature embryos produced varying numbers of non-transgenic plants from each original immature embryo for a total of one hundred sixteen (116) plants produced. In the second treatment, a total of seventy-four (74) immature embryos were infected with the mixture of *Agrobacterium* strains in the ratio 90% PHP71539 (SEQ ID NO: 184) to 10% PHP71539 (SEQ ID NO: 184)+PHP88158 (SEQ ID NO: 182) and the number of regenerated plants from each of the infected immature embryos increased substantially with half of the originally treated immature embryos producing two (2) or more plants from the scutellum, with a total of two hundred twenty-two (221) plants being produced (see Table 24). The second treatment provided a substantial improvement in the final number of non-transgenic plants and provided a substantial improvement in micro-propagation producing non-transgenic plants that were then ready for transfer to the greenhouse. The final molecular analysis confirmed that the plants generated by this method were non-transgenic, containing no T-DNA with the morphogenic expression cassette(s) and no *Agrobacterium* plasmid backbone sequences (present in both plasmids) being integrated. Table 24 shows the number of *Agrobacterium*-infected immature embryos that produced varying numbers of non-transgenic plants from scutellar-derived somatic embryos.

TABLE 24

| | No. of immature embryos producing "X" number of plants | | | | | | | | | Total No. |
|---|---|---|---|---|---|---|---|---|---|---|
| | 1 | 2 | 3 | 4 | 5 | 6 | 7 | 8 | 9 | Plants |
| 100% PHP71539 (SEQ ID NO: 184) | 8 | 7 | 4 | 7 | 1 | 1 | 5 | 1 | 0 | 116 |
| 90% PHP71539 (SEQ ID NO: 184)/ 10% PHP71539 (SEQ ID NO: 184) + PHP88158 (SEQ ID NO: 182) | 4 | 3 | 1 | 10 | 11 | 5 | 4 | 2 | 1 | 221 | b) Experiment 2. Sorghum immature embryos were harvested, transformed using *Agrobacterium*, and cultured, as described above in Experiment 1 of this Example 17. Results for the four treatments are summarized in FIGS. 7-10.

In the (control) first treatment (FIG. 7), fifty-six (56) immature embryos of sorghum variety Tx430 were infected with the *Agrobacterium* containing the virulence plasmid PHP71539 (SEQ ID NO: 184), with a total of twenty-eight (28) producing no response. Of the remaining twenty-eight (28) immature embryos, five (5) each produced one (1) R0 plant, sox (6) each produced two (2) R0 plants, and seventeen (17) immature embryos each produced three (3) or more R0 plants per starting immature embryo, ranging as high as eight (8) R0 plants for one (1) starting embryo. All R0 plants produced were confirmed by qPCR to be non-transgenic (contained no integrated *Agrobacterium* sequences). Tabulating the total R0 plants produced one hundred two (102) relative to the fifty-six (56) starting immature embryos treated resulted in a total R0 propagation frequency of 182% (102 R0 plants/56 embryos).

Figure 8:
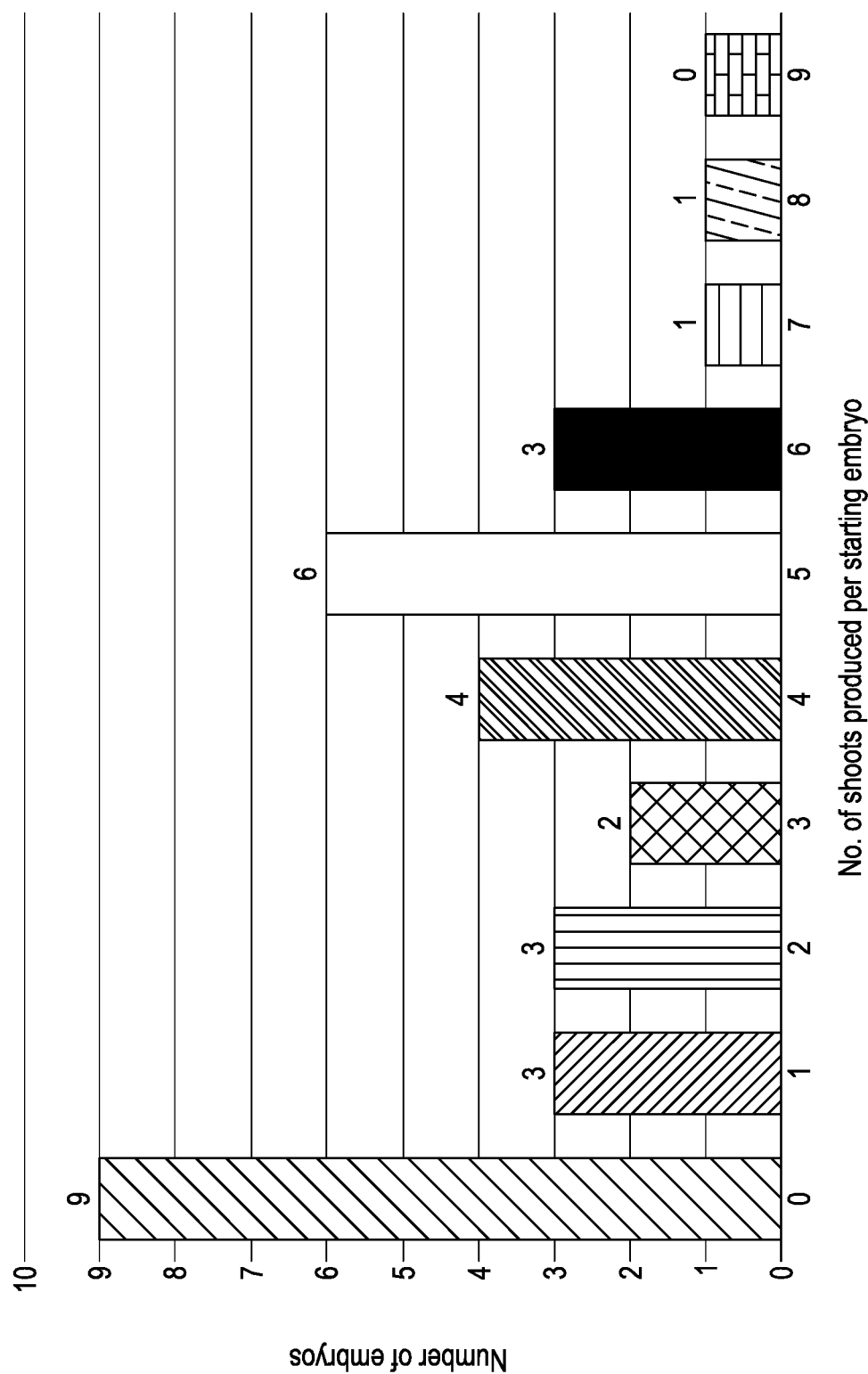
FIG. 8 shows the number of wild-type sorghum R0 plants recovered (x axis) per starting embryo (y axis) after *Agrobacterium* infection with 3XENH::PLTP::WUS2. A total of 33 immature embryos were infected with the *Agrobacterium* with a cumulative production of 103 shoots resulting in a 312% propagation frequency.

In the second treatment (FIG. 8), where the second *Agrobacterium* where the second *Agrobacterium* containing both PHP71539 (SEQ ID NO: 184) and PHP88158 (SEQ ID NO: 182) (RB+3XENH::ZM-PLTP PRO::ZM-WUS2:: IN2-1 TERM+NOS PRO::CRC::SB-GKAF TERM+LB) was mixed with the *Agrobacterium* containing only PHP71539 (SEQ ID NO: 184), a total of thirty-three (33) sorghum immature embryos were infected, with a total of nine (9) immature embryos each producing no R0 plants (FIG. 8). For the remaining immature embryos in this treatment, the number of R0 plants produced/embryo ranged from one (1) R0 plant (observed for each of three (3) starting embryos) up to nine (9) R0 plants for one (1) starting embryo. For this treatment, a total of one hundred three (103) R0 plants were produced for a R0 propagation frequency of 312% (103 R0 plants/33 embryos).

Figure 9:
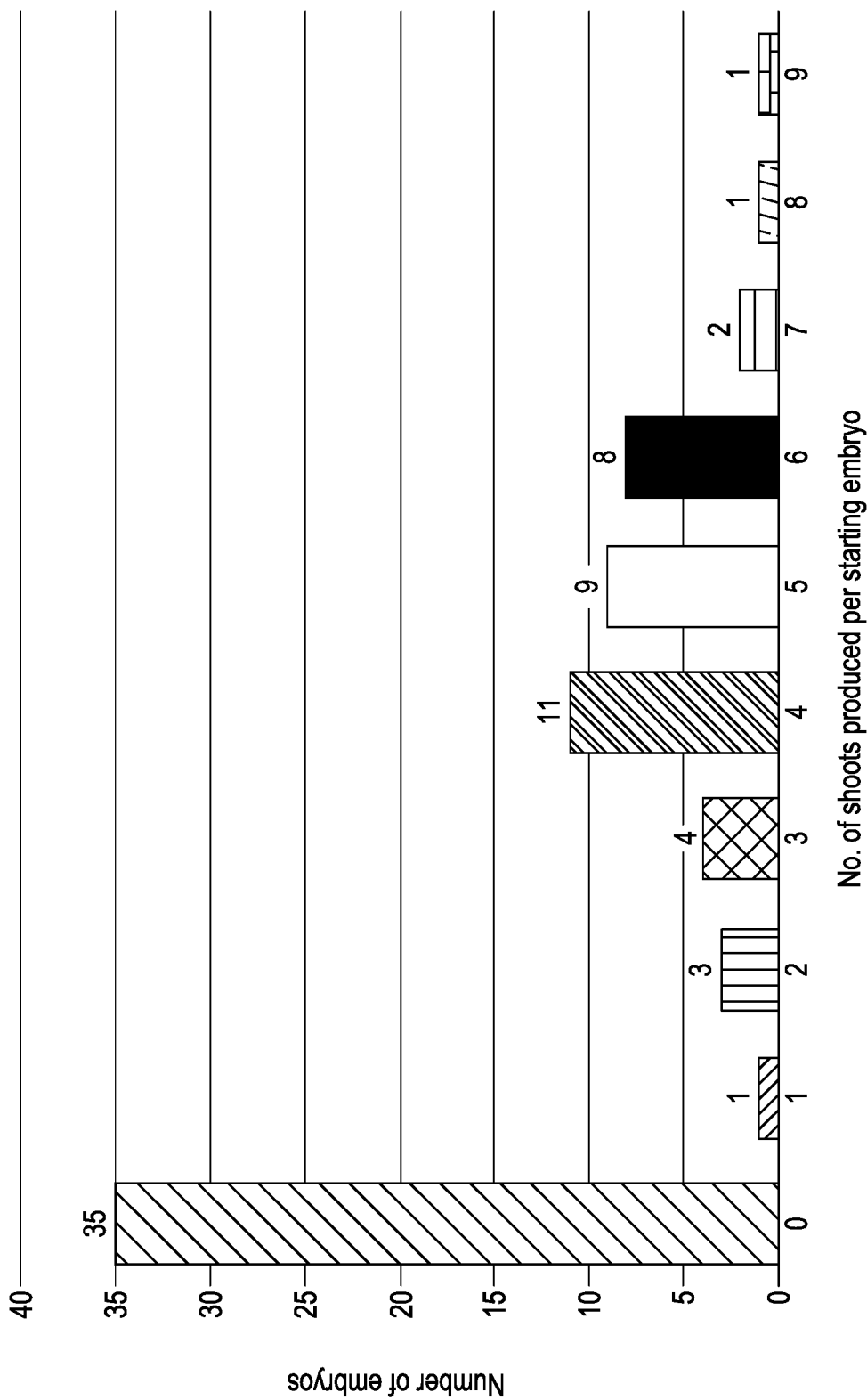
FIG. 9 shows the number of wild-type sorghum R0 plants recovered (x axis) per starting embryo (y axis) after *Agrobacterium* infection with PLTP::ODP2. A total of 75 immature embryos were infected with the *Agrobacterium* with a cumulative production of 187 shoots resulting in a 249% propagation frequency.

In the third sorghum treatment (FIG. 9), where the second *Agrobacterium* containing both PHP71539 (SEQ ID NO: 184) and PHP25340 (SEQ ID NO: 193) (RB+UBI PRO:: CFP::PINII TERM+3XENH::ZM-PLTP PRO::ZM-ODP2:: IN2-1 TERM+LB) was mixed with the *Agrobacterium* containing only PHP71539 (SEQ ID NO: 184), a total of seventy-five (75) sorghum immature embryos were infected. Thirty-five (35) produced no response (no R0 plants produced). Of the remaining forty (40) immature embryos, the numbers of R0 plants/embryos produced ranged from one (1) to nine (9), with the highest numbers of immature embryos falling in the middle of this range (FIG. 9). For this treatment, a total of one hundred eighty-seven (187) R0 plants were produced from a total of seventy-five (75) immature embryos treated for a R0 propagation frequency of 249% (187 R0 plants/75 embryos).

Figure 10:
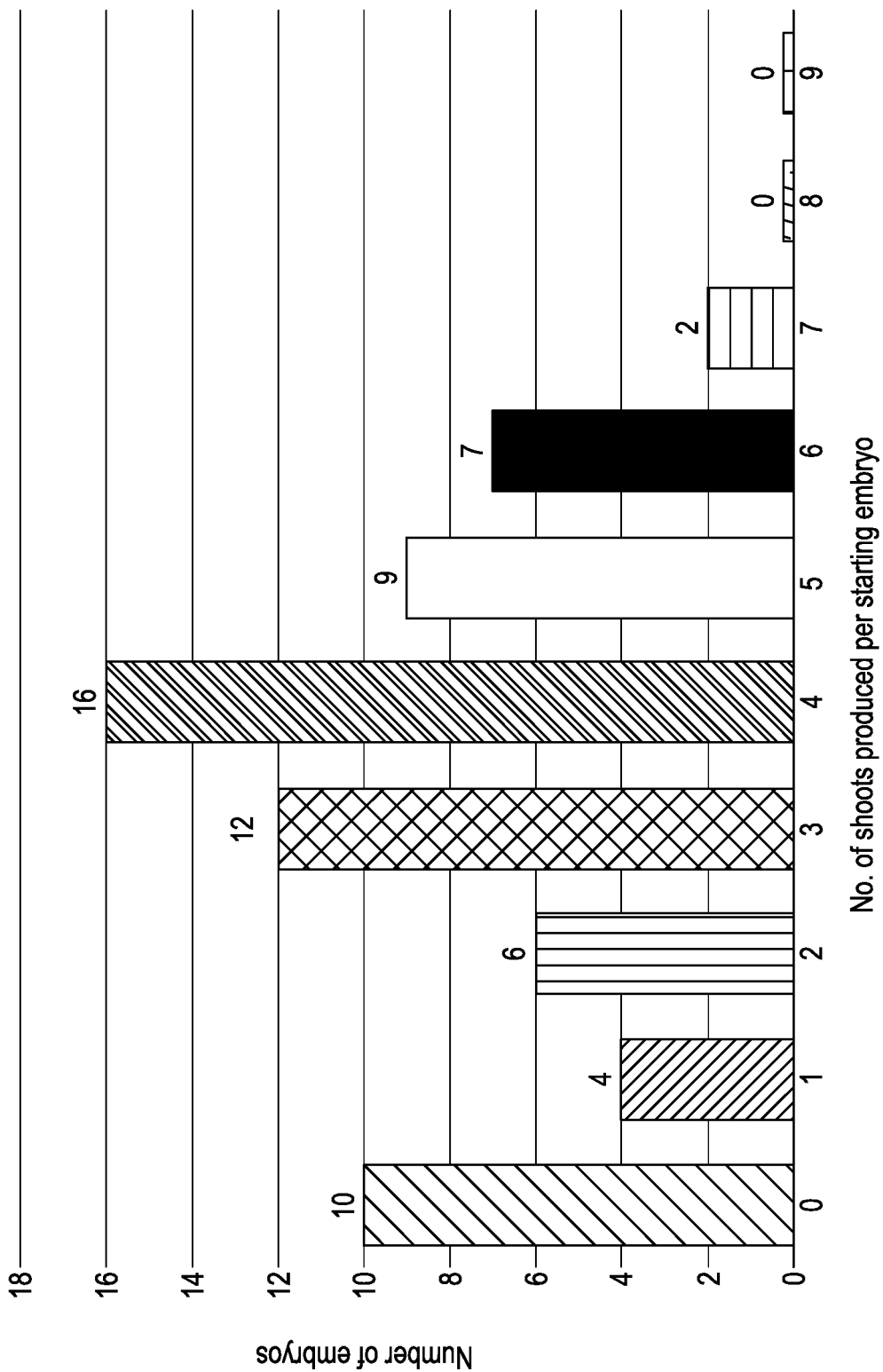
FIG. 10 shows the number of wild-type sorghum R0 plants recovered (x axis) per starting embryo (y axis) after *Agrobacterium* infection with 3XENH::PLTP::WUS2+ PLTP::ODP2 A total of 66 immature embryos were infected with the *Agrobacterium* with a cumulative production of 217 shoots resulting in a 329% propagation frequency.
Figure 11:
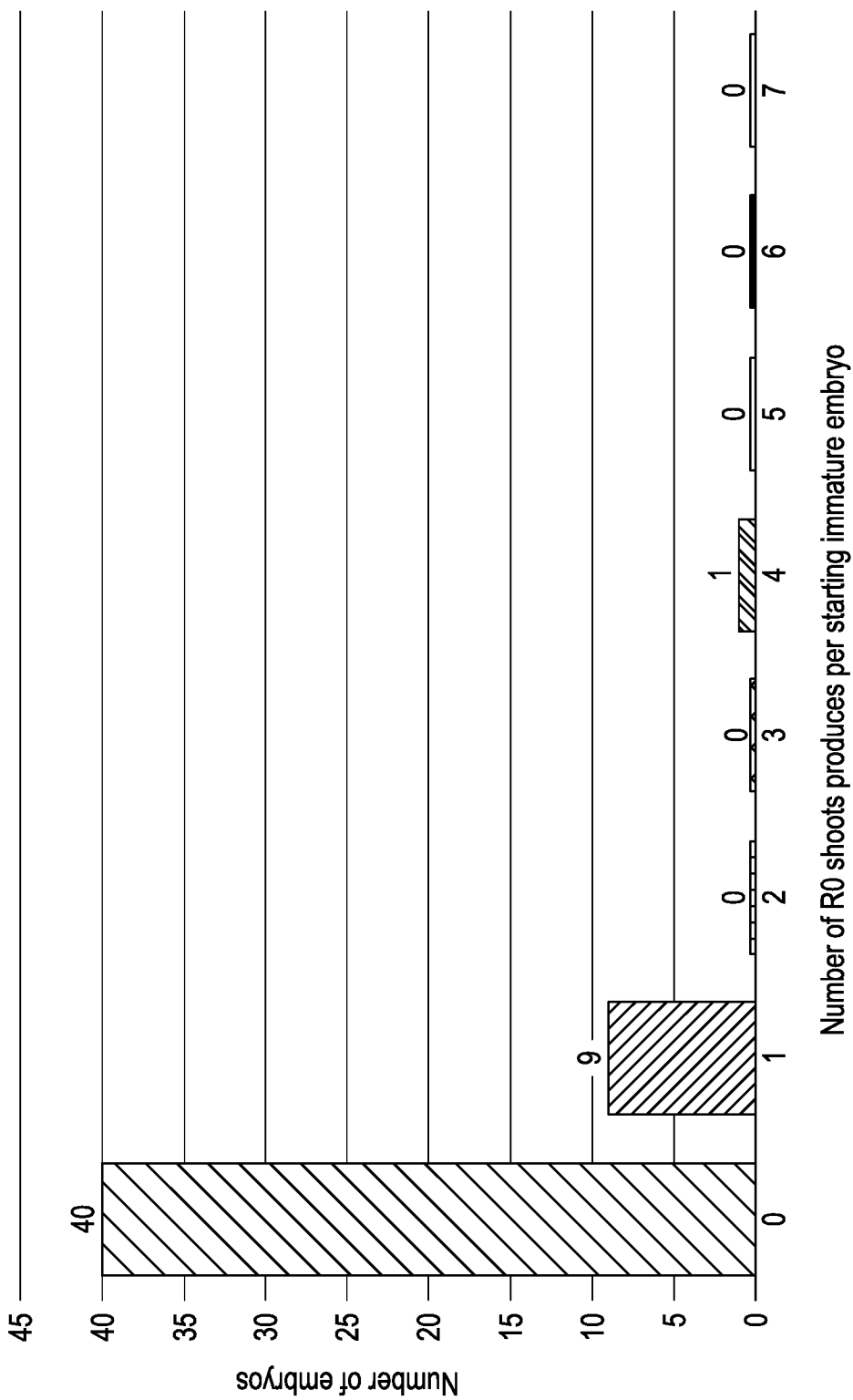
FIG. 11 shows the number of wild-type maize R0 plants recovered (x axis) per starting embryo (y axis) after *Agrobacterium* infection with no T-DNA. A total of 50 immature embryos were infected with the *Agrobacterium* with a cumulative production of 13 shoots resulting in a 26% propagation frequency.
Figure 12:
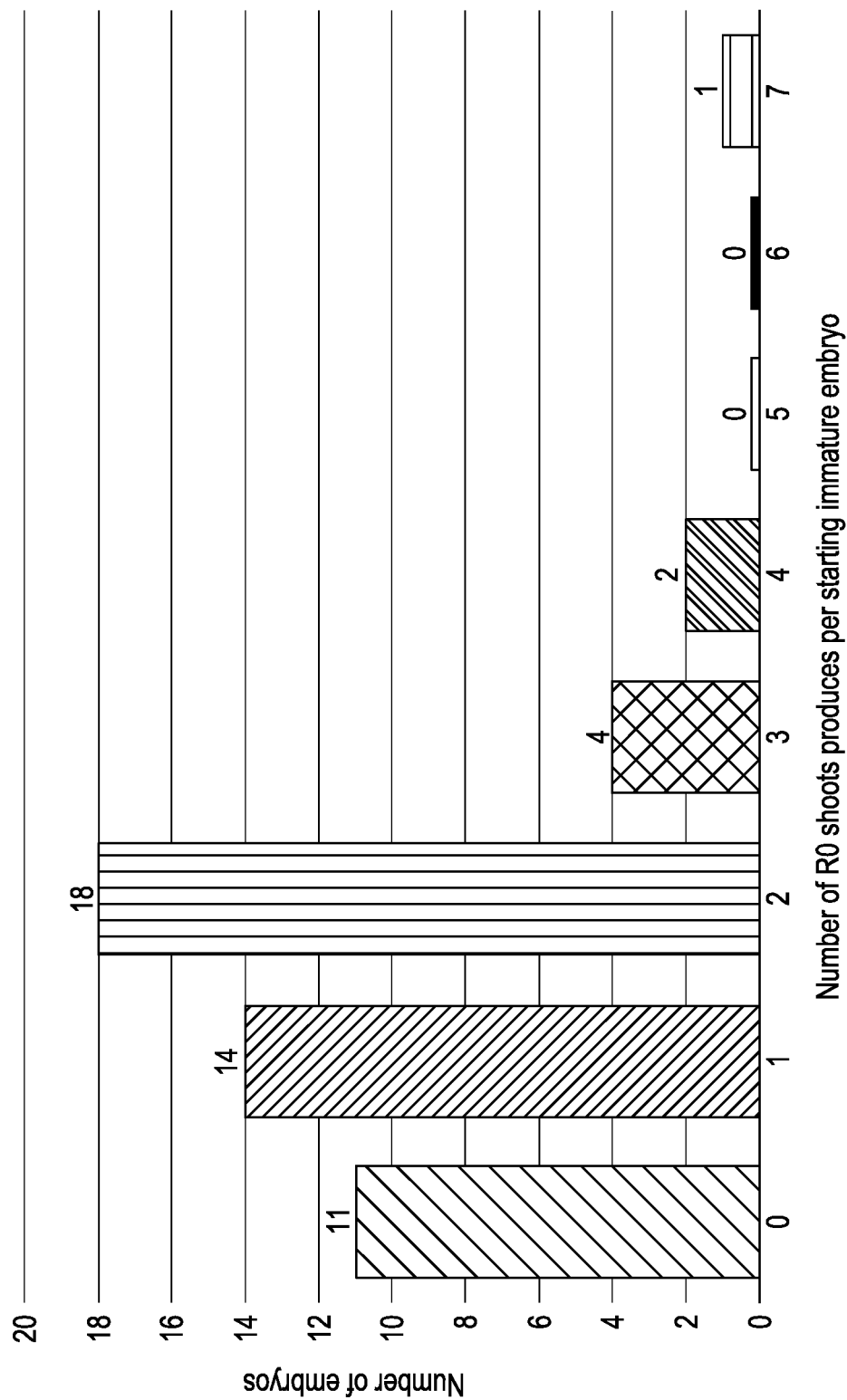
FIG. 12 shows the number of wild-type maize R0 plants recovered (x axis) per starting embryo (y axis) after *Agrobacterium* infection with 3XENH::PLTP::WUS2. A total of 50 immature embryos were infected with the *Agrobacterium* with a cumulative production of 77 shoots resulting in a 154% propagation frequency.
Figure 13:
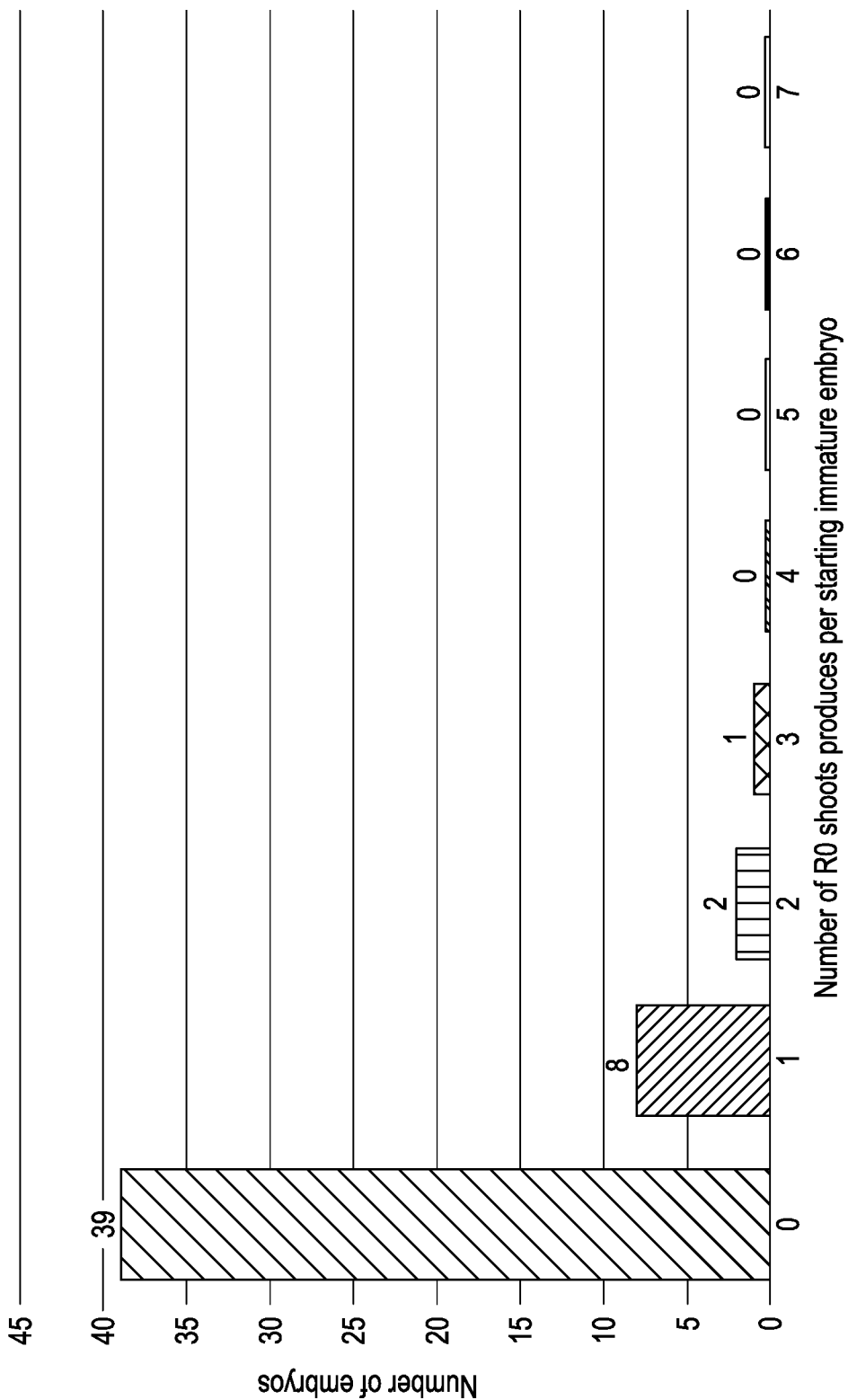
FIG. 13 shows the number of wild-type maize R0 plants recovered (x axis) per starting embryo (y axis) after *Agrobacterium* infection with PLTP::ODP2. A total of 50 immature embryos were infected with the *Agrobacterium* with a cumulative production of 13 shoots resulting in a 26% propagation frequency.
Figure 14:
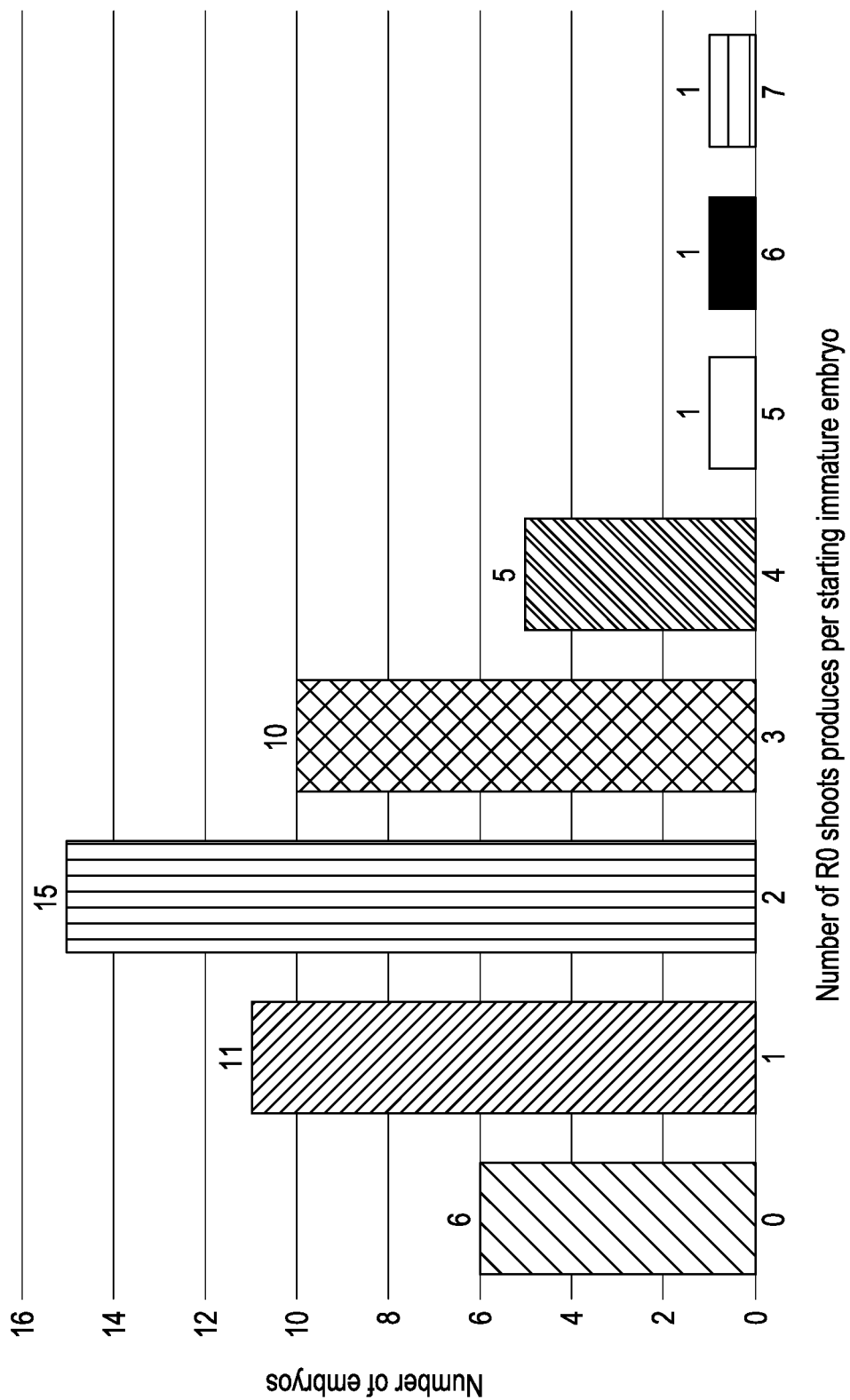
FIG. 14 shows the number of wild-type maize R0 plants recovered (x axis) per starting embryo (y axis) after *Agrobacterium* infection with 3XENH::PLTP::WUS2+PLTP:: ODP2. A total of 50 immature embryos were infected with the *Agrobacterium* with a cumulative production of 109 shoots resulting in a 218% propagation frequency.

In the final treatment for sorghum (FIG. 10), where the second *Agrobacterium* containing both PHP71539 (SEQ ID NO: 184) and PHP91539 (SEQ ID NO: 194) (RB+3XENH:: ZM-PLTP PRO::ZM-WUS2::IN2-1 TERM+ZM-PLTP1 PRO::ZM-ODP2::OS-T28 TERM+NOS PRO::CRC::SB-GKAF TERM+LB) was mixed with the *Agrobacterium* containing only PHP71539 (SEQ ID NO: 184) the R0 plant propagation rate was again greatly simulated (FIG. 10). In this treatment, a total of sixty-six (66) Tx430 immature embryos were treated and only ten (10) immature embryos produced no (0) R0 plants. The remaining fifty-six (56) starting immature four (4) embryos each produced one (1) R0 plant, six (6) embryos each produced two (2) R0 plants, twelve (12) embryos each produced three (3) R0 plants, sixteen (16) embryos each produced four (4) R0 plants, nine (9) embryos each produced five (5) R0 plants, seven (7) embryos each produced six (6) R0 plants, and two (2) embryos each produced seven (7) R0 plants. For this treatment, a total of two hundred seventeen (217) R0 plants were produced from the sixty-six (66) starting immature embryos, for a R0 plant propagation frequency of 329% (217 R0 plants/66 embryos).

For all three treatments where either ODP2, WUS2, or ODP2/WUS2 were introduced, a substantial increase in the total frequency of R0 plants produced as a function of starting embryo number was observed in sorghum—when compared to the control. The substantial improvement in R0 plant propagation observed in all three morphogenic gene treatments is summarized in terms of total R0 propagation frequency (relative to the starting number of immature embryos) in Table 22 and is presented as the fold-increase relative to the control treatment in Table 23. Table 22 shows the R0 propagation frequency (%) after *Agrobacterium* infection harboring no T-DNA (SEQ ID NO: 184), or a T-DNA containing either 3XENH::PLTP::ODP2 (SEQ ID NO: 193), 3XENH::PLTP::WUS2 (SEQ ID NO: 182), or 3XENH::PLTP::WUS2 plus PLTP::ODP2 (SEQ ID NO: 194). Table 23 shows the fold-increase in R0 propagation frequency (%) after *Agrobacterium* infection harboring a T-DNA containing either PLTP::ODP2 (ODP2), 3XENH:: PLTP::WUS2 (WUS), or 3XENH::PLTP::WUS2 plus PLTP::ODP2 (WUS/ODP2)—relative to the control treatment where the *Agrobacterium* contained no T-DNA (control).

All plants produced in this experiment were sampled for qPCR analysis, to determine the copy number of sequences internal to the T-DNA of the second *Agrobacterium*, or a sequence found only in the *Agrobacterium* plasmid backbone (VIRG—which was present in both the first and second *Agrobacterium* strains). For all recovered plants, molecular analysis confirmed that R0 plants generated by this method were non-transgenic, containing no T-DNA with the morphogenic gene expression cassette(s) or no *Agrobacterium* plasmid backbone sequences (with the helper plasmid backbone having been present in both the first and second *Agrobacterium*).

Example 18: Using Viral Enhancers with the Maize PLTP Promoter to Drive WUS2 Expression Enhances Recovery of Non-Transgenic Somatic Embryos and Plants in Maize a) Experiment 1. Maize embryos are prepared as described above. *Agrobacterium* strain LBA4404 THY-containing the virulence plasmid PHP71539 (SEQ ID NO: 184) is used in all treatments. In a (control) first treatment, an *Agrobacterium* containing PHP71539 (SEQ ID NO: 184) (with no T-DNA) is adjusted to an OD of 0.4 (550 nm) in liquid 700 A medium, and immature maize embryos are added to the *Agrobacterium* suspension for 15 minutes at room temperature (25° C.). In a second treatment, a second *Agrobacterium* containing both PHP71539 (SEQ ID NO: 184) and PHP88158 (SEQ ID NO: 182) (RB+3XENH::ZM-PLTP PRO::ZM-WUS2::IN2-1 TERM+NOS PRO::CRC::SB-GKAF TERM+LB) is mixed with the *Agrobacterium* containing only PHP71539 (SEQ ID NO: 184), both *Agrobacterium* strain suspensions first being adjusted to an OD of 0.4 (550 nm) and then mixed at a ratio of 90% PHP71539 alone (SEQ ID NO: 184) to 10% PHP71539 (SEQ ID NO: 184)+PHP88158 (SEQ ID NO: 182). In a third treatment, a second *Agrobacterium* containing PHP71539 (SEQ ID NO: 184) and RV025340 (SEQ ID NO: 193) (RB+UBI PRO::CFP::PINII TERM+3XENH::ZM-PLTP PRO::ZM-ODP2::IN2-1 TERM+LB) is mixed with the *Agrobacterium* containing only PHP71539 (SEQ ID NO: 184), both *Agrobacterium* strain suspensions first being adjusted to an OD of 0.4 (550 nm) and then mixed at a ratio of 90% PHP71539 alone (SEQ ID NO: 184) to 10% RV025340 (SEQ ID NO: 193)+PHP71539 (SEQ ID NO: 184). In a fourth treatment, a second *Agrobacterium* containing PHP71539 (SEQ ID NO: 184)+PHP91539 (SEQ ID NO: 194) (RB+3XENH::ZM-PLTP PRO::ZM-ODP2::ZM-PLTP1 PRO::ZM-ODP2::OS-T28 TERM+NOS PRO::CRC::SB-GKAF TERM+LB) is mixed with the *Agrobacterium* containing only PHP71539 (SEQ ID NO: 184), both *Agrobacterium* strain suspensions first being adjusted to an OD of 0.4 (550 nm) and then mixed at a ratio of 90% PHP71539 alone (SEQ ID NO: 184) to 10% PHP91539 (SEQ ID NO: 194)+PHP71539 (SEQ ID NO: 184). After the 15-minute liquid infection treatment, the immature embryos are removed from the liquid medium and transferred onto solid medium 562V and oriented scutellum-side up for culture at 21° C. in the dark overnight.

For all four treatments, fifty (50) immature embryos of maize inbred PH1V69 are infected. In the (control) first treatment containing the virulence plasmid PHP71539 (SEQ ID NO: 184) (with no T-DNA), it is expected that the treated immature embryos will produce a low number of non-transgenic plants germinated from scutellum-derived somatic embryos. For the fifty (50) immature embryos infected in the second treatment with a mixture of *Agrobacterium* strains in the ratio 90% PHP71539 (SEQ ID NO: 184) to 10% PHP88158 (SEQ ID NO: 182)+PHP71539 (SEQ ID NO: 184), it is expected that the number of R0 plants from each of the infected immature embryos will increase substantially. The improvement in the final number of non-transgenic plants represents a substantial improvement in micro-propagation production of non-transgenic plants that are then ready for transfer to the greenhouse. In the third treatment with a mixture of *Agrobacterium* strains in the ratio 90% PHP71539 (SEQ ID NO: 184) to 10% RV025340 (SEQ ID NO: 193) (RB+UBI PRO::CFP::PINII TERM+3XENH::ZM-PLTP PRO::ZM-ODP2::IN2-1 TERM+LB)+PHP71539 (SEQ ID NO: 184), the number of R0 plants produced is expected to be higher than of the (control) first treatment with PHP71539 alone (SEQ ID NO: 184). In the fourth treatment with a mixture of *Agrobacterium* strains in the ratio 90% PHP71539 (SEQ ID NO: 184) to 10% PHP71539 (SEQ ID NO: 184)+PHP91539 (SEQ ID NO: 194) containing both PLTP::WUS2 and PLTP1::ODP2 it is expected that the number of R0 plants produced will be as high as the number of R0 plants produced in the second treatment (a mixture of *Agrobacterium* strains in the ratio 90% PHP71539 (SEQ ID NO: 184) to 10% PHP71539 (SEQ ID NO: 184)+PHP88158 (SEQ ID NO: 182)). The final molecular analysis is expected to confirm that the plants generated by this method are non-transgenic, containing no T-DNA with the morphogenic expression cassette(s) and no *Agrobacterium* plasmid backbone sequences (present in both plasmids).

b) Experiment 2. Maize inbred PH1V69 immature embryos were harvested, transformed using *Agrobacterium*, and cultured, as described above in Experiment 1 of this Example 18. Results for the four treatments are summarized in FIGS. 11-14.

In the (control) first treatment (FIG. 11), fifty (50) immature embryos of maize inbred PH1V69 were infected with the *Agrobacterium*, with a total of forty (40) producing no response (zero (0) R0 plants). Of the remaining ten (10) immature embryos, nine (9) each produced one (1) R0 plant, while one (1) immature embryo produced four (4) R0 plants. Tabulating the total R0 plants produced (13) relative to the total number of starting immature embryos (50) resulted in a total R0 propagation frequency of 26% (13 R0 plants/50 embryos).

In the second treatment (FIG. 12), where the second *Agrobacterium* contained PHP71539 (SEQ ID NO: 184) and PHP88158 (SEQ ID NO: 182) (RB+3XENH::ZM-PLTP PRO::ZM-WUS2::IN2-1 TERM+NOS PRO::CRC::SB-GKAF TERM+LB), a total of fifty (50) maize immature embryos were infected, with a total of eleven (11) immature embryos producing no R0 plants. For the remaining immature embryos in this treatment, the number of R0s produced/embryo were fourteen (14) starting embryos each produced one (1) R0 plant, eighteen (18) starting embryos each produced two (2) R0 plants, four (4) starting embryos each produced three (3) R0 plants, two (2) starting embryos each produced four (4) R0 plants, and one (1) starting embryo each produced seven (7) R0 plants. For this treatment, a total of seventy-seven (77) R0 plants were produced for a R0 propagation frequency of 154% (77 R0 plants/50 embryos).

In the third maize treatment (FIG. 13), where the second *Agrobacterium* containing PHP71539 (SEQ ID NO: 184) and RV025340 (SEQ ID NO: 193) (RB+UBI PRO::CFP::PINII TERM+3XENH::ZM-PLTP PRO::ZM-ODP2::IN2-1 TERM+LB) a total of fifty (50) maize immature embryos were infected, with a total of thirty-nine (39) immature embryos producing no R0 plants. Of the remaining eleven (11) immature embryos, eight (8) immature embryos each produced one (1) R0 plant, two (2) embryos each produced two (2) plants, and one (1) immature embryo produced three (3) R0 plants. For this treatment, a total of 15 R0 plants were produced resulting in a R0 propagation frequency of 30% (15 R0 plants/50 embryos).

In the fourth treatment for maize (FIG. 14), in which the second *Agrobacterium* contained PHP71539 (SEQ ID NO: 184)+PHP91539 (SEQ ID NO: 194) (RB+3XENH::ZM-PLTP PRO::ZM-WUS2::IN2-1 TERM+ZM-PLTP1 PRO::ZM-ODP2::OS-T28 TERM+NOS PRO::CRC::SB-GKAF TERM+LB), the R0 plant propagation rate was again greatly simulated. In this treatment, of fifty (50) PH1V69 immature embryos treated with the *Agrobacterium* mixture, only six (6) embryos produced no R0 plants. Of the remaining forty-four (44) starting immature embryos, eleven (11) immature embryos each produced one (1) R0 plant, fifteen (15) immature embryos each produced two (2) R0 plants, ten (10) immature embryos each produced three (3) R0 plants, five (5) immature embryos each produced four (4) R0 plants, one (1) immature embryo produced five (5) R0 plants, one (1) immature embryo produced six (6) R0 plants, and one (1) immature embryo produced seven (7) R0 plants. For this treatment, a total of one hundred nine (10) 9 R0 plants were produced from the fifty (50) starting immature embryos, for a R0 plant propagation frequency of 218% (109 R0 plants/50 embryos).

As summarized in Tables 22 and 23, the substantial improvement in R0 plant propagation observed in all three morphogenic gene treatments is summarized in terms of total R0 propagation frequency (relative to the starting number of immature embryos) in Table 22 and is presented as the fold-increase relative to the control treatment in Table 23.

All R0 plants produced in this experiment were sampled for qPCR analysis, to determine the copy number of sequences internal to the T-DNA of the second *Agrobacterium*, or a sequence found only in the *Agrobacterium* plasmid backbone (VIRG—which was present in both the first and second *Agrobacterium* strains). For all four treatments, molecular analysis confirmed that all maize R0 plants generated by this method were non-transgenic, containing no T-DNA with the morphogenic expression cassette(s) and no *Agrobacterium* plasmid backbone sequences (with the helper plasmid backbone having been present in both the first and second *Agrobacterium*).

Example 19: Using T-DNA Plasmids with Different Origins of Replication for Modulating Plasmid Copy Number For these experiments, two different T-DNAs are delivered in varying ratios (relative to each other) from a single bacterial cell by harboring these T-DNAs on two plasmids with different origins of replication (ORI). The different ORIs vary in the number of the plasmids maintained with a bacterial cell. The different ORIs can be used for titrating the plasmid copy numbers to achieve different ratios of the plasmids in the same bacterial cell. In this experiment one designs a plasmid having one or more ORI selected from the following ORIs: BBR1 ORI; PSA ORI; PSA+PARDE ORI; PVS1 ORI; repABC ORI; RK2 ORI; RK2+PARDE ORI; or RSF1010 ORI (see Table 25) residing within the same bacterial cell. Within these various ORIs, it was previously determined that pVS1 confers high plasmid copy number (~20 copies/cell) and repABC confers low copy number (~1-2 copies/cell) in *Agrobacterium*.

TABLE 25

| SEQ ID NO: | DESCRIPTION |
|---|---|
| 195 | BBR1 ORI; *Agrobacterium tumefaciens* |
| 196 | PSA ORI; *Agrobacterium tumefaciens* |
| 197 | PSA + PARDE ORI; *Agrobacterium tumefaciens* |
| 198 | PVS1 ORI; *Agrobacterium tumefaciens* |
| 199 | repABC ORI; *Agrobacterium tumefaciens* |
| 200 | RK2 ORI; *Agrobacterium tumefaciens* |
| 201 | RK2 + PARDE ORI; *Agrobacterium tumefaciens* |
| 202 | RSF1010 ORI; *Agrobacterium tumefaciens* |

To validate this concept, a first plasmid is constructed with an ORI that results in high plasmid copy number (pVS1) and a T-DNA that contains trait gene expression cassettes such as ZS-GREEN and HRA. A second plasmid is constructed with an ORI that results in low copy number (repABC) and a T-DNA that contains a morphogenic gene expression cassette (WUS2). Both plasmids are introduced into a single *Agrobacterium*. When the plasmids residing within the same bacterial cell are co-delivered into the same plant cell, the relative ratio of delivered T-DNAs will reflect the stable ratio of these plasmids in the *Agrobacterium*.

In this manner, a similar effect is produced when compared to the method of mixing two different Agrobacteria containing either a trait gene expression cassette T-DNA or a morphogenic gene expression cassette T-DNA (i.e., in a 90%/10% mixture of *Agrobacterium* 1 and *Agrobacterium* 2). Like the *Agrobacterium* mixing method, delivery of plasmid mixtures from the same bacterial strain can result in a higher frequency of cells receiving both T-DNAs and permit a higher transformation frequency. When used for transformation, it is expected that a higher frequency of rapidly forming somatic embryos and resultant T0 plants containing a single copy trait gene expression cassette T-DNA with no vector (plasmid) DNA and without integration of morphogenic gene expression cassette T-DNA will be produced.

Example 20: Generating Clonal Doubled Haploids from a Non-Responsive Microspore-Derived Cell In Example 12, a method useful for improving microspore embryogenesis in cells originating from a responsive maize inbred line was shown. For that method, the improved embryogenesis was observed in response to an *Agrobacterium* containing an expression cassette operably linked to the *Z. mays* PLTP promoter, a relatively strong promoter in a cell having an embryogenic cell fate and a relatively weak activity in a cell having a non-embryogenic cell fate.

While it was shown that the method in Example 12 can improve microspore embryogenesis in a microspore-derived cell isolated from a responsive line, that method was not observed to equally improve microspore embryogenesis in a microspore-derived cell isolated from a non-responsive line (data not shown). Hence, there remains a need to further improve methods useful for inducing microspore embryogenesis in a genotype-independent manner, notably for maize inbreds with recalcitrant microspore embryogenesis phenotypes.

The methods of the present disclosure describe a method to treat multicellular structures derived from a cultured microspore isolated form a recalcitrant inbred line using an *Agrobacterium* containing an expression cassette operably linked a promoter with relatively strong activity in a cell having a partial, or non-embryogenic cell fate.

Promoters of interest to the current method are regulatory elements comprising promoter sequences known to be active in plant cells, including but not limited to "constitutive" or "inducible" plant promoters, such as promoters listed in Tables 4 and 5. Such regulatory elements can include polynucleotide sequences encoding EMEs disclosed in Table 6 and or sequences encoding translation or transcription enhancers disclosed in Table 7.

Of interest to the present disclosure are regulatory elements comprising a promoter sequence with relatively strong promoter activity in a paternal gamete cell. Examples of promoter sequences useful in the present disclosure are listed in Table 26 below.

TABLE 26

| Identifier: | Name | Source | DNA SEQ ID NO: |
|---|---|---|---|
| dpzm03g024500 PRO | RmlC-like cupin | Zea mays | 318 |
| dpzm09g008400 PRO | Ubiquitin | Zea mays | 319 |
| dpzm01g090870 PRO | Tubulin alpha-1 | Zea mays | 320 |
| dpzm06g001180 PRO | [frk2] fructokinase 2 | Zea mays | 321 |
| dpzm08g032600 PRO | 40S ribosomal protein S26-2-like | Zea mays | 322 |
| dpzm04g059940 PRO | 40S ribosomal protein S15a-1-like | Zea mays | 323 |
| dpzm05g051270 PRO | Cyclophilin type peptidyl-prolyl cis-trans isomerase | Zea mays | 324 |
| dpzm08g051700 PRO | Ribosomal protein L5 eukaryotic/L18 archaeal | Zea mays | 325 |
| dpzm02g070510 PRO | 40S ribosomal protein SA-like | Zea mays | 326 |
| dpzm03g044630 PRO | Ribosomal protein L5 eukaryotic/L18 archaeal | Zea mays | 327 |
| dpzm04g015310 PRO | Ferredoxin-1 | Zea mays | 328 |
| dpzm08g002650 PRO | 40S ribosomal protein S5-like | Zea mays | 329 |
| dpzm06g003090 PRO | WPP domain-associated protein-like | Zea mays | 330 |
| dpzm07g039000 PRO | 60S ribosomal protein L14-1-like | Zea mays | 331 |
| dpzm03g034880 PRO | 40S ribosomal protein S9-2-like | Zea mays | 332 |
| dpzm05g006980 PRO | [tua4] alpha tubulin4 | Zea mays | 333 |
| dpzm06g001500 PRO | [arpp1a] acidic ribosomal protein | Zea mays | 334 |
| dpzm01g081700 PRO | 60S ribosomal protein L10-like | Zea mays | 335 |
| dpzm06g001640 PRO | 40S ribosomal protein S13-like | Zea mays | 336 |
| dpzm07g047460 PRO | Translation elongation factor EF1B | Zea mays | 337 |
| dpzm04g016000 PRO | 60S acidic ribosomal protein P1-like | Zea mays | 338 |
| dpzm06g038090 PRO | 60S ribosomal protein L18-3-like | Zea mays | 339 |
| dpzm03g050170 PRO | 40S ribosomal protein S23-like | Zea mays | 340 |
| dpzm08g032890 PRO | 60S ribosomal protein L24-like | Zea mays | 341 |
| dpzm02g017130 PRO | 60S ribosomal protein L23a-like | Zea mays | 342 |

Another promoter sequence providing a high level of specificity for expression in developing pollen, particularly at the mid-uninucleate stage is the P67 promoter (see patent U.S. Pat. No. 7,915,398 B2 incorporated herein by reference in its entirety) that can be used in the methods of the present disclosure for treatment of a paternal gametic cell derived from a non-responsive inbred line. In this construct, the T-DNA polynucleotide replaces the ZM-PLTP promoter sequence used in plasmid RV020636 (SEQ ID NO: 186) with the P67 promoter sequence (named ZM-PME10 PRO in RV038288), resulting in plasmid RV038288 (SEQ ID NO: 185).

In the present disclosure, it is of interest to transform plasmid RV038288 into an *Agrobacterium* strain that is an auxotroph, for example a conditional thymidine auxotrophic mutant (Thy A-) auxotroph, and or a strain that co-expresses a gene conferring conditional negative selection, for example using the bacterial cytosine deaminase (codA) gene, as described in Example 11.

In this method, embryogenic growth is stimulated in a non-transformed, microspore-derived cell in response to WUSCHEL protein activity provided by a first cell containing a T-DNA from plasmid RV038288. Further, expressing the WUSCHEL protein from the T-DNA becomes lethal to the first cell, particularly when using said conditional negative selection methods, thereby conferring improved microspore embryogenesis to a non-transformed, microspore-derived cell while selecting against a cell with a T-DNA. Thus, the current method can be used for generating a microspore-derived doubled haploid plant. More preferentially, said method can generate clonal, microspore-derived doubled haploid plants from a treated tissue.

For treatment, the tissue of interest is a multicellular structures (MCS) obtained using the methods described in Example 12, particularly using cell cultures from a maize line that is less responsive than ATCC40520.

Agrobacterium-mediated transformation of MCS cells is performed as described in Example 12, here using two Agrobacterium strains in a combined mixture (e.g. 95% PHP86491 & 5% RV038288). The filtered MCS and Agrobacterium mixture are combined in a suspension using 0.5 mL of the suspended MCS cells and 0.5 mL combined Agrobacterium mixture, allowed to incubate for 5 minutes under sterile conditions, transferred to a solid medium (e.g. 605J), and incubated under dark conditions at 21° C. After 24 hours, each plate was transferred to 28° C. and incubated under dark conditions.

Preferentially, the method can be practiced as described in Example 12, including the use of a chromosome doubling treatment. Proliferating callus tissue can be transferred to a maturation medium with selection, for example 289Q medium supplemented with 5-fluorocytosine. Optionally, conditional selection methods can also be practiced during or after proliferating callus tissue of each treated microspore-derived embryo is dissected. For example, by transferring of each portion of dissected tissue being transferred to maturation medium (289Q) supplemented with 5-fluorocytosine and cultured at 26-28° C. under dark conditions.

It is also envisioned that co-expression of more than one morphogenic developmental gene can improve the microspore embryogenesis response in a genotype-independent manner, for example by providing both WUSCHEL and BABYBOOM/ODP2 protein activities to a microspore-derived cell. Other such proteins useful for the present disclosure can include but are not limited to other morphogenic developmental genes, such as LEC1 and or a geminivirus RepA gene.

This method is expected to improve the capability to regenerate a paternally-derived doubled haploid plant from a cultured maize microspore.

It is expected that a microspore embryogenic response for a cell derived from a specific genotype can be improved by using specific combinations of EMEs and or translation or transcription enhancers within the polynucleotide sequences of the regulatory elements.

It is expected that microspore embryogenic responses can be further improved by providing to a microspore-derived cell one or more other morphogenic developmental gene activities to a cell, for example by co-expressing two or more morphogenic developmental genes, particularly in combinations as needed to promote microspore embryogenic responses in a genotype-dependent manner.

Example 21: Regenerating Plants Using Somatic Embryos Derived from Diploid Maize Cells Containing a Pre-Existing Integrated Transgene Examples 5-7 describe novel plant breeding methods using maternal haploid embryos, Examples 12 and 20 describe utility of novel methods towards plant breeding using paternal haploid microspores, and Example 18 describes methods improving the regeneration of plants by treating non-transgenic diploid embryos. Specifically, the methods of Example 18 provide capabilities for obtaining non-transgenic plants that contain no T-DNA with the morphogenic expression cassette(s) and no Agrobacterium plasmid backbone sequences (present in both plasmids).

In the method of the present disclosure, methods for obtaining a clonal plant is described wherein the initial plant cell contains a stably integrated T-DNA, and thus is considered a transgenic plant cell, that is treated to produce somatic embryos capable of regenerating clonal, transgenic plants. Notably, said transgenic plants contain only the original stably integrated T-DNA and contain no T-DNA with the morphogenic expression cassette(s) and no Agrobacterium plasmid backbone sequence (present in any plasmids).

Maize embryos are prepared as described above. Agrobacterium strain LBA4404 THY-containing the virulence plasmid PHP71539 (SEQ ID NO: 184) is used in all treatments. In the first treatment, PHP71539 (SEQ ID NO: 184) containing no T-DNA is adjusted to an OD of 0.4 (550 nm) in liquid 700 A medium, and immature maize embryos are added to the Agrobacterium suspension for 15 minutes at room temperature (25° C.). In the second treatment, a second Agrobacterium containing both PHP71539 (SEQ ID NO: 184) and PHP88158 (SEQ ID NO: 182) (RB+3XENH::ZM-PLTP PRO::ZM-WUS2::IN2-1 TERM+NOS PRO::CRC:: SB-GKAF TERM+LB) is mixed with the Agrobacterium containing PHP71539 (SEQ ID NO: 184), both Agrobacteria suspensions first being adjusted to an OD of 0.4 (550 nm) and then mixed at a ratio of 90% PHP71539 (SEQ ID NO: 184) to 10% PHP88158 (SEQ ID NO: 182)+PHP71539 (SEQ ID NO: 184). In a third treatment, a second Agrobacterium containing PHP71539 (SEQ ID NO: 184) and RV025340 (SEQ ID NO: 193) (RB+UBI PRO::CFP::PINII TERM+3XENH::ZM-PLTP PRO::ZM-ODP2::IN2-1 TERM+LB) is mixed with the Agrobacterium containing PHP71539 (SEQ ID NO: 184), both Agrobacteria suspensions first being adjusted to an OD of 0.4 (550 nm) and then mixed at a ratio of 90% PHP71539 (SEQ ID NO: 184) to 10% RV025340 (SEQ ID NO: 193) and PHP71539 (SEQ ID NO: 184). In a fourth treatment, a second Agrobacterium containing PHP71539 (SEQ ID NO: 184)+PHP91539 (SEQ ID NO: 194) (RB+3XENH::ZM-PLTP PRO::ZM-WUS2:: IN2-1 TERM+ZM-PLTP1 PRO::ZM-ODP2::OS-T28 TERM+NOS PRO::CRC::SB-GKAF TERM+LB) is mixed with the Agrobacterium containing PHP71539 (SEQ ID NO: 184), both Agrobacteria suspensions first being adjusted to an OD of 0.4 (550 nm) and then mixed at a ratio of 90% PHP71539 (SEQ ID NO: 184) to 10% PHP91539 (SEQ ID NO: 194) and PHP71539 (SEQ ID NO: 184). After the 15-minute liquid infection treatment, the immature embryos are removed from the liquid medium and transferred onto solid medium 562V and oriented scutellum-side up for culture at 21° C. in the dark overnight.

For all four treatments, 50 immature embryos of a maize line PH1V69 containing a stably integrated T-DNA, herein referred to as a transgenic "trait", are infected with *Agrobacterium*. In the first treatment containing the virulence plasmid PHP71539 (SEQ ID NO: 184) (with no T-DNA), it is expected that the treated immature embryos will produce a low number of plants from scutellum-derived somatic embryos. For the fifty (50) immature embryos infected with a mixture of *Agrobacterium* strains in the ratio 90% PHP71539 (SEQ ID NO: 184) to 10% PHP88158 (SEQ ID NO: 182) and PHP71539 (SEQ ID NO: 184), it is expected that the number of derived plants from each of the infected immature embryos will increase substantially. The final number of clonally derived plants represents a substantial improvement in propagating plants, here containing the stably integrated T-DNA (e.g. a transgenic "trait"). In the treatment with RV025340 (SEQ ID NO: 193) RB+UBI PRO::CFP::PINII TERM+3XENH::ZM-PLTP PRO::ZM-ODP2::IN2-1 TERM+LB, the number of produced plants is expected to be higher than for the first treatment with PHP71539 (SEQ ID NO: 184) alone, and the final treatment with PHP71539 (SEQ ID NO: 184)+PHP91539 (SEQ ID NO: 194) containing both PLTP::WUS2 and PLTP1::ODP2 will be as high as the PHP71539 (SEQ ID NO: 184)+ PHP88158 (SEQ ID NO: 182) treatment.

The final molecular analysis is expected to confirm that the plants generated by this method are transgenic regarding only the first, stably integrated T-DNA (e.g. a transgenic "trait") while containing no T-DNA with a morphogenic expression cassette(s) and no *Agrobacterium* plasmid backbone sequences (present in both plasmids).

Example 22: Regenerating Plants Using Somatic Embryos Derived from Diploid Maize Cells Containing a Pre-Existing Genome Modification Examples 5-7 describe novel plant breeding methods using maternal haploid embryos, Examples 12 and 20 describe utility of novel methods towards plant breeding using paternal haploid microspores, and Example 18 describes methods improving the regeneration of plants by treating non-transgenic diploid embryos. Specifically, the methods of Example 18 provide capabilities for obtaining non-transgenic plants that contain no T-DNA with the morphogenic expression cassette(s) and no *Agrobacterium* plasmid backbone sequences (present in both plasmids). Conversely, Example 21 describes methods for obtaining a clonal plant wherein the initial plant cell contains a stably integrated T-DNA, and thus is considered a transgenic plant cell, that is treated to produce somatic embryos capable of regenerating clonal, transgenic plants.

The method of the present disclosure describes methods for obtaining a clonal plant wherein the initial plant cell's genome contains a targeted genome modification resultant from previous activity of a programmable, site directed nuclease. Such genome modifications can be modifications comprising repair of a double strand break (DSB) without the addition a repair template, for example causing a deletion of DNA base pair(s), a SDN-1 method; non-homologous end joining repair of a DSB caused by cleavage at two target sites, for example a gene "knock-out", a SDN-2 method; or a DSB at a target site in the genomic DNA accompanied by a homology directed repair using a template containing a gene or other sequence of genetic material that is transferred into the DSB target site and repaired using the cell's natural repair process exemplifies gene targeting, a SDN-3 method.

It is expected a capability for regenerating clonal plants using somatic embryos derived from diploid maize cells containing a pre-existing genome modification can achieved using the methods as described in Example 21

The final molecular analysis is expected to confirm that the plants generated by this method are genome modified regarding only site directed modifications while containing no T-DNA with a morphogenic expression cassette(s) and no *Agrobacterium* plasmid backbone sequences (present in both plasmids).

Example 23: Using FLP-Mediated SSI with Altruistic Micropropagation in a Haploid Embryo Rapidly Produced Clonal Fixed SSI Events Pioneer inbred PH184C containing a transgenic locus is used as the Site-Specific Integration (SSI) target line, the transgenic target locus contains RB+UBI1ZM PRO:: UBI1ZM INTRON1::FRT1::PMI::PINII TERM+FRT6+ LB. This inbred line, homozygous for the target locus, is pollinated with a haploid-inducer line to produce haploid embryos. Immature ears are harvested from PH184C and 2.0 mm immature embryos are extracted from the kernels on the day of *Agrobacterium*-mediated transformation and based on both anthocyanin and fluorescent markers the embryos are sorted to enrich for only haploid embryos.

Two *Agrobacterium* "strains" are prepared for transformation, one strain (Agro1) being transformed with a plasmid PHP88158 (SEQ ID NO: 182) in which the T-DNA contains RB+FMV ENH:PSCV ENH:MMV ENH:ZM-PLTP PRO:: ZM-WUS2::IN2-1 TERM+NOS PRO::CRC::SB-GKAF TERM+LB, and the second (Agro2) being transformed with a T-DNA-containing plasmid (PHV00003) (SEQ ID NO: 345) with the configuration RB+UBI1ZM PRO::UBI1ZM INTRON1::FLPM-EXON1::ST-LS1 INTRON2-V2:: FLPM-EXON2::PINII+FRT1+NPTII::PINII TERM+ UBI1ZM PRO::UBI1ZM INTRON1::DS-RED2 (ALT1):: PINII TERM+FRT6+LB. Thus, Agro1 will deliver a T-DNA with an altruistic WUS cassette which will stimulate somatic embryo formation, and Agro2 will deliver a T-DNA with a FLP recombinase expression cassette+the SSI donor sequence+a DS-RED2 marker sequence. The two *Agrobacterium* strains are streaked onto fresh culture plates as previously described and cultured overnight.

Freshly isolated haploid embryos are placed in 700 A medium until all the haploid embryos are harvested and ready for transformation. The two *Agrobacterium* strains are collected from the solid plates on which they grew overnight and resuspended in 700 A liquid medium. The density of both strains is adjusted to OD500 nm=0.4, and then the two strains are mixed at a ratio of 10% Agro1 (WUS) to 90% Agro2 (SSI-donor). The embryos are then suspended in the *Agrobacterium* mixture, gently inverted twice to mix the suspension, and then left at room temperature for 15 minutes for initial *Agrobacterium* infection to occur. The suspension (containing the *Agrobacterium*-mixture and the leaf tissue) is poured through a sterile stainless-steel mesh to collect the leaf tissue, and this tissue is then transferred onto a filter paper resting on the surface of fresh culture medium (resting medium with no selection). At the end of the resting stage, the filter paper supporting the leaf segments is transferred onto culture medium containing 150 mg/l G418. After 2-weeks selection, newly-formed somatic embryos are transferred onto maturation medium to stimulate shoot formation, and finally the shoots are transferred onto rooting medium for 2 weeks before the plantlets can be transferred to soil in the greenhouse.

At the plantlet stage, leaf tissue is sampled for PCR analysis to confirm that the genes within the flanking FRT1 and FRT6 sites of the original target locus are no longer present and that the new genes within the donor cassette have recombined into the target locus correctly—and precise RMCE (Recombinase-Mediated Cassette Exchange) events are identified. Using this method, it is anticipated that i) SSI events are recovered at a frequency greater than 5% (based on the number of confirmed SSI T0 plants relative to the starting number of immature embryos), ii) use of the altruistic WUS *Agrobacterium* results in rapid proliferation of SSI+ somatic embryos and germination to form multiple clonal SSI+T0 plants, and iii) that due to colchicine-induced doubling early in the process after successful SSI, many SSI+T0 plants are homozygous for the recombined SSI locus.

Example 24: Methods Improving Regeneration of Amphiploid Plants

Wide hybridization is a plant breeding tool, including both interspecific and intergeneric hybridization, used to produce a hybrid from a cross of related species or genera that do not normally sexually reproduce with each other, herein referred to as a 'wide cross'. Wide hybridization is the first step to introduce and transfer desirable trait(s) from a wild species, often referred to as an 'alien' species, into a cultivated species lacking a favorable phenotype for said trait(s).

Introgression has two key steps: sexual hybridization to bring the wild or 'alien' genome into a cultivated background and homologous and/or homoeologous recombination to eliminate or replace the deleterious alleles and/or genes causing a reduction in fitness in a cultivated species. However, deleterious genes introgressed along with the beneficial gene transferred from a wild, 'alien' species can occur. Thus, a major disadvantage when using wild genetic resources is that amphiploids, the first-generation hybrid containing a diploid set of chromosomes from both parents, can have reduced fitness due to deleterious genes transferred from 'alien' species as reported in the art.

For this reason, backcrossing is often performed, wherein an amphiploid is crossed to the cultivated species to obtain offspring with a genetic identity closer to that of the cultivated species parent. In each back-cross generation, the beneficial gene from the 'alien' genome is maintained, while a gene conferring an unfavorable trait(s) is selected against. Recombination is required during each generation to obtain novel recombinants to 'break' such linkage between genes conferring beneficial and unfavorable traits. Multiple generations of backcrossing are typically performed using the cultivated species as the 'recurrent' parent to obtain a plant possessing the original agronomic fitness of the cultivated species with, ideally, only the introgressed gene(s) transferred from the 'alien' species conferring improved phenotypic performance for said trait(s).

Thus, the phenotypic diversity of landraces, local cultivars and related species are sources of genetic variation useful for crop improvement, and thus, are useful for improving the sustainability of current agricultural production methods. The essential problem in using interspecific hybridization in plant breeding programs, however, is the low probability of obtaining in one individual the desired combination of genes from the parental species. Hence, methods that improve this probability for obtaining the desired outcome are needed in the art.

Clearly, plant breeding methods are not limited to only the backcrossing method as described above. Other methods can include creating populations such as chromosome segment substitution lines, recombinant chromosome substitution lines, near-isogenic lines, as well as chromosome addition and chromosome translocation lines.

Furthermore, these aspects are inclusive of a multitude of interspecific and intergeneric hybridization combinations of interest to plant breeding; there is no effort to fully describe all such interests here. Second, it is understood that use of wide hybridization is not a new concept.

As described herein, a Triticeae example is considered as an exemplary model, given that many synthetic wheats lines have been created using such methods and novel genetic diversity continues being incorporated into wheat breeding programs worldwide. It is also useful given that genetic material for improving such traits is described as a diverse set of Triticeae species comprising primary, secondary, and tertiary gene pools of wheat. These gene pools include wild and cultivated species within the genera *Aegilops*, *Agropyron*, *Ambylopyrum*, *Dasypyrum*, *Elymus*, *Hordeum*, *Leymus*, *Lophopyrum*, *Psathyrostachys*, *Pseudoroegneria*, *Secale*, *Thinopyrum*, and *Triticum*.

In relation to a cultivated species, it is believed that the evolutionary distance between two parental lines is proportional to how 'wide' a cross is, for example, as characterized by DNA sequence differences at the genomic level.

Difference at the genomic level are believed to be underlying factors creating barriers affecting the success of using wide cross methods, despite the potential use of existing biodiversity for genetic gain. Examples of such barriers include but are not limited to meiotic pairing characteristics in diploid hybrids, for example, a lack of chromosome pairing, preferential transmission of chromosomes harboring gametocidal genes, hybridization incompatibility due to sterility, and suppressed recombination, typically due to a lack of synteny. As a result, despite some highly significant successes, introgression remains laborious and time consuming, increasingly so as the genetic basis for trait complexity increases, and therefore it is believed that today's cultivated elite crop gene pools contain only a fraction of the available biodiversity.

Methods for overcoming such barriers include using irradiation to generate translocations and use of gametocidal genes for induced chromosomal breakage. Tissue culture improvements have also been useful in overcoming such barriers.

Despite such improvements, amphiploid seed can remain defective and fail to germinate under normal conditions. A major, albeit simple, advance in the state of the art was the use of embryo rescue to improve regenerating a plant from an immature amphiploid embryo. When such an amphiploid embryo would otherwise perish after being allowed to further develop as a seed, embryo rescue methods improved the probability for obtaining an amphiploidy plant, and thus greater access to genetic diversity present in other gene pools.

Of interest to the present disclosure are methods useful for improving or circumventing remaining barriers that restrict or prevent genetic interchange between related plant populations. Here, the present disclosure describes novel improvements to the state of the art, whereby amphiploid embryos are rescued and treated as described herein. For example, amphiploid embryos can be treated using methods in Examples 3, 8, and 16 to 18, to further improve capabilities of regenerating amphiploid plants, including the capability to obtain more than one amphiploid plant per treated immature embryo.

In the method of the present disclosure, freshly harvested immature seed produced by a wide cross, for example resulting from a wide cross between two Triticeae species, are sterilized with 50% bleach and 0.1% Tween-20 for 30 min under vacuum and then rinsed with sterile water three times. *Agrobacterium* strain LBA4404 THY-containing the virulence plasmid PHP71539 (SEQ ID NO: 184) is used in all treatments. In the first treatment, PHP71539 (SEQ ID NO: 184) containing no T-DNA is adjusted to an OD of 1.0 (600 nm) in liquid 716B medium, and immature amphiploid embryos are added to the *Agrobacterium* suspension for 20 minutes at room temperature (25° C.). In the second treatment, a second *Agrobacterium* containing both PHP71539 (SEQ ID NO: 184) and PHP88158 (SEQ ID NO: 182) (RB+3XENH::ZM-PLTP PRO::ZM-WUS2::IN2-1 TERM+NOS PRO::CRC::SB-GKAF TERM+LB) is mixed with the *Agrobacterium* containing only PHP71539 (SEQ ID NO: 184), both *Agrobacterium* strain suspensions first being adjusted to an OD of 1.0 (600 nm) and then mixed at a ratio of 90% PHP71539 (SEQ ID NO: 184) alone to 10% PHP71539 (SEQ ID NO: 184)+PHP88158 (SEQ ID NO: 182).

After the 15-minute liquid infection treatment, the immature embryos are removed from the liquid medium and transferred onto solid medium 606 medium and oriented scutellum-side up for culture at 21° C. in the dark overnight. The embryos are transferred again onto fresh resting medium (606) for 10 days, then onto regeneration medium 689E with selection in the dark. The tissue is then moved onto regeneration medium 689E with selection in the light.

Using the chromosome doubling methods using colchicine as described in Example 6, a treated embryo exposed to a chromosome doubling agent before, during, or after the *Agrobacterium* co-infection steps can produce one or more first-generation hybrid plants containing a diploid set of chromosomes from both parents, or amphiploid plants. After germination, the plants produced are potted to soil, and the count of clonal plants per treated embryo are recorded.

Tissue can be collected from a plant and biomolecules such as DNA, RNA, proteins, and or metabolites can be isolated for diagnostic analysis. Such diagnostic methods include, but are not limited, to DNA sequencing methods, DNA polymerase chain reaction amplification, transcript profiling methods, proteomics, metabolomics, and epigenomics, as well we the respective analysis methods supporting each diagnostic method.

In another aspect, it is conceived that present disclosure can further improve introgression, for example by treating an immature embryo derived from a wide cross that is treated in a manner as described in Example 9. More specifically, the current method provides to a cell contacted by a WUS protein at least one genome modification enzyme and at least one gRNA enabling a target site mutation, for example a genomic target site encoding a deleterious allele within the alien genome. Using the methods of Example 9, wherein the immature embryo is treated with a combination of plasmids as described in Table 18. Here is it conceived that such a method provides an advantage for recovering wide cross hybrids with improved vigor.

In another aspect, it is conceived the method can be used to provide to a cell contacted by a WUS protein at least one genome modification enzyme and at least one gRNA enabling more than one target site mutation, for example at least one genomic target site within the genome of the cultivated species and at least one genomic target site within the alien species, to promote recombination at such targeted genomic regions. Preferentially, at least two gRNA can be designed for two genomic target sites within the alien species to cause a donor template to be obtained from the genome of the alien species. Thus, it is conceived that such a method provides an advantage to improve the ease and frequency for introgressing genomic DNA from an alien species into a double-strand break site of the cultivated species.

It is expected that outcomes of this Example 24 will provide an improved capability for obtaining a non-transgenic amphiploid plant from an immature embryo produced by a wide-cross. Preferentially, the plant will contain no T-DNA from the morphogenic expression cassette(s) and no *Agrobacterium* plasmid backbone sequences. More preferentially, it is expected said method will enable novel capabilities for obtaining clonal, non-transgenic amphiploid plants from an immature wide cross embryo.

Thus, in one aspect, it is expected that wide hybridization crosses can be obtained with improved efficiencies, and plant breeding programs can more effectively introgress and evaluate novel genetic variants existing in landraces, local cultivars and related species.

In another aspect, the results of the current method are expected to improve generating and selecting wide cross progeny with a reduced frequency of deleterious alleles. Such a method can be expected to reduce the preferential transmission of chromosomes harboring gametocidal genes. Thus, the method of the present disclosure is expected to improve capabilities for using wild genetic resources in wide crosses.

In another aspect, the methods of the present disclosure can be used to overcome other barriers to wide cross methods, such as barriers caused by a lack of chromosome pairing, hybridization incompatibility due to sterility, or suppressed recombination caused by a lack of synteny. It is expected that the methods described here for creating a targeted double strand break in the genome of a cultivated species genome while simultaneously providing donor template from an alien species can improve the frequency for recovering wide cross progeny having 'alien' introgressions. Such a capability is expected to improve methods for creating populations such as chromosome segment substitution lines, recombinant chromosome substitution lines, near-isogenic lines, as well as chromosome addition and chromosome translocation lines.

Together, the results of the present disclosure are expected to reduce the amount of time and labor required for breeding methods aiming to widen the breadth of available biodiversity within today's cultivated elite crop gene pools. When combined with other methods of plant breeding, it is furthermore expected that the methods of the present disclosure will increase the probability of obtaining in one individual the desired combination of genes from the parental species used in wide crosses.

Example 25: Using Nanoparticle-Mediated Delivery for AMP (in Either Immature Embryos or Seedling-Derived Leaf Segments)

a) Delivery of DNA. Carbon nanotubules are functionalized with plasmid DNA containing a WUS2 expression cassette, by first treating the carbon nanotubules with polyethyleneimine (PEI), and then incubating with plasmid DNA which is attracted to the PEI, effectively binding the DNA to the nanotubule in an irreversible manner. For example, these PEI-functionalized nanotubules are loaded with the plasmid DNA cargo (containing 3XENH::PLTP::WUS2+UBI::ZS-GREEN expression cassettes) Once DNA is attached, freshly harvested maize immature embryos are suspended in the nanotubule/DNA mixture, and nanotubule/protein complexes move into the plant cell. Upon entry into the plant cell and then into the nucleus, the plasmid-contained genes are expressed to encode both WUS2 and ZS-GREEN protein, stimulating de novo formation of green-fluorescent somatic embryos. The DNA continues to be expressed while still bound and protected by the nanotubule, prolonging the stimulation of green-fluorescent somatic embryo formation.

b) Delivery of RNA. Carbon nanotubules are functionalized with Wus2 and ZS-GREEN RNA, by first treating the carbon nanotubules with polyethyleneimine (PEI), and then incubating with in vitro-transcribed RNA, effectively binding the RNA to the nanotubule in an irreversible manner. For example, these PEI-functionalized nanotubules are loaded with the RNA cargo (both WUS2 and ZS-GREEN RNAs). Once RNA is attached, freshly harvested maize immature embryos are suspended in the nanotubule/RNA mixture, and nanotubule/protein complexes move into the plant cell. Upon entry into the plant cell and then into the nucleus, the RNAs are transcribed to encode both WUS2 and ZS-GREEN protein, stimulating de novo formation of green-fluorescent somatic embryos. The RNA continues to be expressed while still bound and protected by the nanotubule, prolonging the stimulation of green-fluorescent somatic embryo formation.

c) Delivery of proteins. Carbon nanotubules are functionalized with protein, either through covalent linkage or non-covalent attractions. For example, the surface of the nanotubules are covalently modified to add functional groups to the surface that can form ester linkages with other organic molecules such as nucleic acids or polypeptides. These functionalized nanotubules are then incubated with proteins such as WUS2. Once protein is attached, freshly harvested maize immature embryos are suspended in the nanotubule/protein liquid, and nanotubule/protein fusions move into the plant cell. Upon entry into the plant cell, endogenous esterase proteins cleave the ester linkage between the WUS2 proteins and the nanotubules resulting in release of the protein for diffusion into the nucleus and transcriptional regulation of other genes to stimulate de novo somatic embryo formation.

d) The flexibility of nanotubule delivery for simultaneous Cas9-mediated genome editing and WUS2/ODP2 stimulation of somatic embryo formation results in rapid production of clonally-propagated edited plants. Using variations of the above treatments, mixtures of nanotubules pre-loaded with DNA, RNA, proteins, or Ribonucleoproteins (RNPs) are used.

Example 26: Use of Nanotubule Delivery of FLP, the RMCE Donor Cassette, and the WUS Gene for Site-Specific Integration Carbon nanotubules are functionalized with i) plasmid DNA containing a SSI donor sequence, ii) a plasmid with a FLP recombinase expression cassette, and iii) a plasmid containing a WUS2 expression cassette, by first treating the carbon nanotubules with polyethyleneimine (PEI), and then incubating with plasmid DNA which is attracted to the PEI, effectively binding the DNA to the nanotubule in an irreversible manner. For example, the SSI donor sequence within plasmid PHV00002 (SEQ ID NO: 344) contains FRT1+NPTII::PINII TERM+UBI1ZM PRO::UBI1ZM INTRON1::ZS-GREEN1::PINII TERM+FRT6, the FLP recombinase plasmid contains the expression cassette ZM1UBI PRO::FLPm::PINII TERM (PHV00004, SEQ ID NO: 346), and the WUS2 plasmid contains 3XENH::PLTP PRO::WUS2::IN2-1 TERM (PHV00005, SEQ ID NO: 347). For each of these three plasmids, a separate aliquot of the PEI-functionalized nanotubules are loaded with one plasmid DNA cargo for each batch of particles. Once the plasmids are attached, the three nanotubule/plasmid complexes can be mixed together in different ratios to determine the optimal ratio for optimal frequencies of site-specific integration.

Freshly harvested maize immature embryos of an inbred containing a pre-integrated Recombination Target Site (i.e. RTL-45 on chromosome 1, with ZM1UBI PRO::PMI::PINII TERM+ZM1UBI PRO::AM-CYAN::PINII TERM) are harvested. The immature embryos are then suspended in the nanotubule/DNA mixture (containing a mixture of DONOR: FLP:WUS2 plasmids at a molar ratio of 45:45:10, respectively) and nanotubule/DNA complexes move into the plant cell. Upon entry into the plant cell and then into the nucleus, the plasmid-contained expression cassettes encode both FLP and WUS2 protein, with FLP catalyzing Recombinase-Mediated Cassette Exchange (RMCE) between the donor plasmid and the RTL-45 target site, and WUS2 stimulating de novo formation of somatic embryos. The DNA continues to be expressed while still bound and protected by the nanotubule, prolonging the opportunity for successful SSI and somatic embryo propagation. Since the DNA delivered by the nanotubules is not released, random integration does not occur.

Example 27: Delivery of Cas9, gRNA and New Templates for Recombination Target Locus into Haploid Embryos to Rapidly Produce New SSI Target Sites in New Elite Inbreds An *Agrobacterium* strain LBA4404 THY-containing a T-DNA with components for Cas9-mediated homology directed repair (HDR) is used. The T-DNA contains RB+LOXP+AXIG1::WUS2::IN2-1 TERM+PLTP::ODP2:: PINII TERM::CZ19B1 TERM+ZM1UBI PRO::ZM1UBI 5UTR::ZM1UBI INTRON1::NLS::CAS9 EXON1::ST-LS1 INTRON2::CAS9 EXON2::VIRD2 NLS::PINII TERM+ ZM-U6 POLIII CHR8 PRO::ZM-CHR1-52.56-8CR1:: GUIDE RNA::ZM-U6 POLIII CHR8 TERM+ZM-HSP18 A PRO::MO-CRE EXON1::ST-LS1 INTRON2::MO-CRE EXON2::PINII TERM+HR1+LOXP+ZM1UBI PRO:: FRT1::NPTII::PINII TERM+FRT6+HR2+LB (PHV00007, SEQ ID NO: 348). HR1 and HR2 represent homology arms in the elite genome HDR-target site, where Cas9 cut-sites are positioned just proximal to each homology arm. Upon *Agrobacterium*-mediated transformation and Cas9-mediated HDR, the template HR1+LOXP+ZM1UBI PRO::ZM1UBI 5UTR::ZM1UBI INTRON1::FRT1::NPTII::PINII TERM+ FRT6+HR2 (PHV00008, SEQ ID NO: 349) is cut from the T-DNA locus and integrated into the elite inbred target site via homology-dependent recombination. After a 10-day resting period, the immature embryos are exposed to a heat treatment of 45° C. for two hours. Chromosome doubling and clonal propagation of the transgenic event results in a new elite inbred that is now homozygous for the Recombination Target Site (RTL) which can be used for site-specific integration at high efficiency.

Example 28: Particle Bombardment

Prior to bombardment, ten (10) to twelve (12) days after pollination (DAP) immature embryos were isolated from ears of the Pioneer inbred PH184C and placed on culture medium plus 16% sucrose for three (3) hours to plasmolyze the scutellar cells.

Different types of plasmids were typically used for each particle bombardment depending on the desired outcome: 1) a plasmid containing a morphogenic gene expression cassette such as 3×ENH::PLTP::WUS2::In2-1 (PHV00005, (SEQ ID NO: 347)) that stimulates embryo formation in neighboring or adjacent cells; 2) a plasmid containing the expression cassette UBI PRO::FLPm::pinII (PHV00004, (SEQ ID NO: 346)) and a second plasmid containing the FRT-flanked donor cassette for Recombinase-Mediated Cassette Exchange (PHV00002, (SEQ ID NO: 344)); or 3) a plasmid containing an expression cassette UBI PRO::CAS9::pinII (PHV00009, (SEQ ID NO: 352)) and an expression cassette with U6 PRO:gRNA::U6 TERM (PHV00010, (SEQ ID NO: 353)) and when applicable a donor cassette for homology-dependent recombination (PHV00011, (SEQ ID NO: 354)). Typically, a total of approximately 40 ng of the plasmid mixture was added to 0.6 um gold particles, the four plasmids were mixed by adding 10 ul of each plasmid together in a low-binding microfuge tube (Sorenson Bioscience 39640T) for a total of 40 μl. To this suspension, 50 ul of 0.6 μm gold particles (30 ug/ul) and 1.0 μl of Transit 20/20 (Cat No MIR5404, Mirus Bio LLC) were added, and the suspension was placed on a rotary shaker for 10 minutes. The suspension was centrifuged at 10,000 RPM (~9400×g) and the supernatant was discarded. The gold particles were re-suspended in 120 μl of 100% ethanol, briefly sonicated at low power and 10 μl was pipetted onto each flier. The fliers were then air-dried to remove all the remaining ethanol. Particle bombardment was performed using a Biolistics PDF-1000 device, at 28 inches of Mercury using a 200 PSI rupture disc.

Example 29: *Agrobacterium*-Mediated Delivery of a Morphogenic Factor to an Adjacent Cell Improves RNP-Mediated Polynucleotide Modification of a Haploid Target Cell This example demonstrates that *Agrobacterium* mediated delivery of a T-DNA sequence encoding a WUS protein into maize immature embryo cells is sufficient to support embryogenesis and regeneration of plants with targeted mutations/deletions and no WUS gene integration at practical frequencies.

Previously, plant transformation and genome editing approaches required delivery of various DNA vectors coding for different "helper" components, including double-strand break reagents (for example, meganucleases, ZFNs, TALENs, or Cas9 nuclease and guide RNA (gRNA)), a selectable marker, morphogenic factors (e.g., ODP2 and WUS), in addition to the "donor" DNA—single-stranded or double-stranded oligonucleotides in gene editing experiments or plasmid DNA containing parts or entire genes with regulatory elements (promoters and terminators) for insertions as the result of a double-strand break (DSB) through a homology directed repair (HDR) pathway.

Multiple, co-delivered DNA molecules tend to co-integrate into a DSB site through the non-homologous end joining (NHEJ) repair pathway, significantly reducing the frequency of usable events. Moreover, stable integration of CRISPR components may lead to plant chimerism and increase the chances of off-site mutagenesis. Minimizing the introduction of the described above "helper" DNA molecules into the target cell, and limiting delivery to the donor DNA, may be beneficial and lead to higher frequencies of quality events (QEs).

Previously, we have described a method for Cas9-gRNA delivery in the form of ribonucleoproteins (RNPs) using gold microparticles. We also described a method for activation of broken pre-integrated selectable marker gene through non-homologous end joining (NHEJ) mechanism upon Cas9-gRNA delivery as DNA vectors or RNP complex (see US20180327785(A1) incorporated herein by reference in its entirety).

Morphogenic factor genes (also referred to as "developmental genes" or "morphogenic genes"), for example include but are not limited to, ODP2 and WUS are desired components of the transformation process. Their delivery into plant cells facilitates cell division and significantly increases transformation frequencies. Moreover, these genes allow successful transformation of many elite genotypes, which transformation, otherwise, cannot be effectively accomplished. However, stable integration of morphogenic factor genes (e.g., ODP2 and WUS) into the target cell genome may have deleterious effects on plant regenerability and fertility.

Here we conduct biolistic delivery of ribonucleotide protein complex (RNP) containing the complexed Cas9 with the mixture of two guide-RNA (gRNA) molecules targeting the genomic DNA sequences of SEQ ID NO: 350 and SEQ ID NO: 351, bombarded into immature embryos as previously described. After particle delivery of RNPs, the immature embryos are suspended in a suspension of *Agrobacterium* strain LBA4404 THY-containing the helper plasmid PHP71539 (SEQ ID NO: 184) and the T-DNA-containing plasmid PHP88158 (RB+FMV ENH:PSCV ENH:MMV ENH:ZM-PLTP PRO::ZM-WUS2::IN2-1 TERM+NOS PRO::CRC::SB-GKAF TERM+LB, (SEQ ID NO: 182)). This allows plant regeneration from cells receiving the DSB and editing components and stimulates cell division and embryogenesis by WUS protein molecules coming from adjacent *Agrobacterium*-infected cells.

A gene deletion of approximately 21 kb in size is generated, starting with particle bombardment of maize immature embryos using 0.6 uM gold particles coated with CAS9 protein complexed to two (2) RNP complexes targeting two sites:

```
site 1
                                   SEQ ID NO: 350
GGATTCCGCGGAAATGGGTG (PAM:CGG); and site 2
                                   SEQ ID NO: 351
GTCAAGGACATACGAGACC (PAM:AGG)
``` to generate the RecQ4 deletion. Plants are regenerated without selection and analyzed by PCR and sequencing, and qPCR for the presence of deletions and WUS integration, respectively. Results such as those predicted in Table 27 would be expected.

TABLE 27

Frequency of RecQ4 gene deletion

| Embryos bombarded | Plants sampled | Plants with RecQ4 deletion | Plants with WUS integration | Plants with deletion No WUS integration |
|---|---|---|---|---|
| 350 | 1000 | >70 | <20 | >70 |

Such results demonstrate efficient, "DNA-free" gene deletion with high efficiency.

Example 30: Particle Delivery of Viral Enhancers with the Maize PLTP Promoter to Drive WUS2 Expression Enhances Recovery of Non-Transgenic Somatic Embryos and Plants in Maize Maize embryos are prepared as described above. Using the particle bombardment device, PHP88158 (SEQ ID NO: 182) containing the expression cassettes 3XENH::ZM-PLTP PRO::ZM-WUS2::IN2-1 TERM and NOS PRO::CRC::SB-GKAF TERM is delivered into the scutellar surface of maize immature embryos and cultured as described above with no selection. As a control, immature embryos are bombarded with a gold/DNA mix containing a plasmid with no morphogenic gene (PHP86491, SEQ ID NO: 183).

When immature embryos of maize inbred PH1V69 are bombarded with PHP88158 (SEQ ID NO: 182) and cultured on embryogenic culture medium, it is expected that prolific embryo formation will occur in cells adjacent to those expressing WUS2 and CRC, and these newly formed non-transgenic somatic embryos will readily germinate to produce plants. For immature embryos in which the control plasmid is introduced, few somatic embryos and plants will be produced.

Example 31: Particle Delivery of a Morphogenic Factor to an Adjacent Cell Improves RNP-Mediated Polynucleotide Modification of A Haploid Target Cell This example demonstrates that particle-delivery of a DNA vector encoding a WUS protein on a separate set of gold particles into maize immature embryo cells is sufficient to support embryogenesis and regeneration of plants with targeted mutations/deletions and no WUS gene integration at practical frequencies.

Previously, plant transformation and genome editing approaches required delivery of various DNA vectors coding for different "helper" components, including double-strand break (DSB) reagents (for example, meganucleases, ZFNs, TALENs, or Cas9 nuclease and guide RNA (gRNA)), a selectable marker, morphogenic factors (e.g., ODP2 and WUS), in addition to the "donor" DNA—single-stranded or double-stranded oligonucleotides in gene editing experiments or plasmid DNA containing parts or entire genes with regulatory elements (promoters and terminators) for insertions as the result of a double-strand break (DSB) through a homology directed repair (HDR) pathway.

Multiple, co-delivered DNA molecules tend to co-integrate into a DSB site through the non-homologous end joining (NHEJ) repair pathway, significantly reducing the frequency of usable events. Moreover, stable integration of CRISPR components may lead to plant chimerism and increase the chances of off-site mutagenesis. Minimizing the introduction of the described above "helper" DNA molecules into the target cell, and limiting delivery to the donor DNA, may be beneficial and lead to higher frequencies of quality events (QEs).

Previously, we have described a method for Cas9-gRNA delivery in the form of ribonucleoproteins (RNPs) using gold microparticles. We also described a method for activation of broken pre-integrated selectable marker gene through non-homologous end joining (NHEJ) mechanism upon Cas9-gRNA delivery as DNA vectors or RNP complex (see US20180327785(A1) incorporated herein by reference in its entirety).

Morphogenic factor genes (also referred to as "developmental genes" or "morphogenic genes"), for example include but are not limited to, ODP2 and WUS are desired components of the transformation process. Their delivery into plant cells facilitates cell division and significantly increases transformation frequencies. Moreover, these genes allow successful transformation of many elite genotypes, which transformation, otherwise, cannot be effectively accomplished. However, stable integration of morphogenic factor genes (e.g., ODP2 and WUS) into the target cell genome may have deleterious effects on plant regenerability and fertility.

Here we describe an approach allowing prevention of morphogenic factor genes ("developmental genes" or "morphogenic genes") integration into the genomes of regenerated plants. First, we demonstrated that delivery of only one of the two morphogenic factor genes (WUS) under a strong promoter (for example, PLTP) was sufficient to stimulate embryogenesis in most tested genotypes. Second, a WUS protein has a naturally-occurring cell-penetrating peptide (CPP) motif and therefore has an ability to penetrate cell walls. Thus, the delivery of vector DNA encoding for WUS into a cell leads to WUS protein expression and its migration to neighboring cells stimulating their division. Moreover, overexpression of the WUS protein in the targeted cell is usually toxic preventing prolonged cell division, embryogenesis and plant regeneration. Based on these observations, we conduct biolistic delivery of RNP and donor DNA on a first set of gold particles (first particle bombardment) followed by delivery of vector DNA containing a WUS expression cassette on a separate set of gold particles (second particle bombardment). This allows plant regeneration from cells receiving the DSB and editing components and stimulates cell division and embryogenesis by WUS protein molecules coming from adjacent cells.

A gene deletion of approximately 21 kb in size is generated, starting with particle bombardment of maize immature embryos using 0.6 uM gold particles coated with CAS9 protein complexed to two (2) RNP complexes targeting two sites:

```
site 1
                                    SEQ ID NO: 350
GGATTCCGCGGAAATGGGTG (PAM:CGG)

site 2
                                    SEQ ID NO: 351
GTCAAGGACATACGAGACC (PAM:AGG)
``` to generate the deletion. The immature embryos are then immediately particle-bombarded with a second set of gold particles coated with a DNA vector encoding for WUS (polynucleotide SEQ ID NO: 182, PHP88158). Plants are regenerated without selection and analyzed by PCR and sequencing, and qPCR for the presence of deletions and WUS integration, respectively. Results such as those predicted in Table 28 would be expected.

TABLE 28

| Frequency of RecQ4 gene deletion | | | | |
|---|---|---|---|---|
| Embryos bombarded | Plants sampled | Plants with RecQ4 deletion | Plants with WUS integration | Plants with deletion No WUS integration |
| 350 | 1000 | 50 | 30 | >50 |

Such results demonstrate efficient, "DNA-free" gene deletion with high efficiency.

As used herein the singular forms "a", "an", and "the" include plural referents unless the context clearly dictates otherwise. Thus, for example, reference to "a cell" includes a plurality of such cells and reference to "the protein" includes reference to one or more proteins and equivalents thereof known to those skilled in the art, and so forth. All technical and scientific terms used herein have the same meaning as commonly understood to one of ordinary skill in the art to which this disclosure belongs unless clearly indicated otherwise.

All patents, publications and patent applications mentioned in the specification are indicative of the level of those skilled in the art to which this disclosure pertains. All patents, publications and patent applications are herein incorporated by reference in the entirety to the same extent as if each individual patent, publication or patent application was specifically and individually indicated to be incorporated by reference in its entirety.

Although the foregoing disclosure has been described in some detail by way of illustration and example for purposes of clarity of understanding, certain changes and modifications may be practiced within the scope of the appended claims.

SEQUENCE LISTING (354 sequences)

SEQ ID NO: 1 - DNA, 879 bp, Arabidopsis thaliana
atggagcctcctcagcaccaacatcaccaccatcaggccgatcaagagtccgggaacaacaacaacaacaagtccggttccggagggtacacttgcagacagacctccaccagatggacacctaccactgagcagatcaagatcctgaaggagttgtactacaacaatgccatccgctcccctactgctgatcagattcagaagatcaccgctcgcctgcgtcaattcggtaagatcgagggtaagaacgtcttctactggttccagaaccacaaggctcgtgagaggcagaagaagcgtttcaacgggactaacatgaccactccttcctcatcacccaattctgttatgatggccgccaacgaccactaccatcctttgcttcatcaccaccacggagttcctatgcaaagacccgcaaactccgtcaacgtgaagttgaaccaggaccatcacctctaccaccacaacaagccctacccctctttcaacaacgggaatctcaaccatgcctcctctggaaccgaatgtggagttgtcaacgcctccaacggctacatgtcttcccacgtgtacggctctatggagcaagattgctccatgaactacaacaacgttggaggcggatgggcaaacatggatcaccactactcctccgctccctacaacttcttcgatagggctaaacctctcttcggcttggagggacaccaagaagaagaggaatgcggaggtgatgcttacttggaacacagaaggactctccctctctttccaatgcacggtgaggaccacatcaacggaggatctggcgctatctggaagtatggacagtccgaggtcagaccatgcgcttccctggaattgagactgaactag

SEQ ID NO: 2 - protein, 292 aa, Arabidopsis thaliana
MEPPQHQHHHHQADQESGNNNNNKSGSGGYTCRQTSTRWTPTTEQIKILKELYYNNAIRSPTADQIQKITARLRQFGKIEGKNVFYWFQNHKARERQKKRFNGTNMTTPSSSPNSVMMAANDHYHPLLHHHHGVPMQRPANSVNVKLNQDHHLYHHNKPYPSFNNGNLNHASSGTECGVVNASNGYMSSHVYGSMEQDCSMNYNNVGGGWANMDHHYSSAPYNFFDRAKPLFGLEGHQEEEECGGDAYLEHRRTLPLFPMHGEDHINGGSGAIWKYGQSEVRPCASLELRLN

SEQ ID NO: 3 - DNA, 876 bp, Lotus japonicus
atggaacaaccacctcaacaacaacaacagaatgaggatggtggtgggagtagtggtggaaaaggggggtttctgagcaggcaaagcagtacacggtggactcccaccacagaccagataagaatattgaaggagctttactacaacaatggaataagatccccgagtgcagagcagattcagaggatctctgctcggctgagacagtacggcaagattgaaggcaagaatgtcttttactggttccagaaccacaaagctagagagaggcagaagaaaaggttcacttctgaaactcatcttcttcccaatcccatacaacaacaacaaagaaatggaactaatgctgcttggaagcaacctgaagaacaacccattattaaccacaccaagtattctagtaacaacatttcagctcctgcagggatcatcacttctgctccatcttcttctgcagagattgtttctgttggccagataggaaactttggttatggatctttgcctatggaaaagagttttagggactgctcaatatctgctggaggcaacacaggctatgctggaagtgctataaaccacaacctgggatggatgggtgtggatccatattcctcagcctacaccaatttctttgacaaaataaggccaactgaagaagaaaccatggaagaagaaggacaagagaatggttcaccagagattgaaacccttcctttattcccgatgcatggtgaggacattcatagtggctatttcaacctcaagtctaattcttctcactatgctggtggctggtaccagactgaagaagggtacttcaacaatggttctcgtgcttccttggagctcagcctcaaatatcctgattttgct

SEQ ID NO: 4 - protein, 292 aa, Lotus japonicus
MEQPPQQQQQNEDGGGSSGGKGGFLSRQSSTRWTPTTDQIRILKELYYNNGIRSPSAEQIQRISARLRQYGKIEGKNVFYWFQNHKARERQKKRFTSETHLLPNPIQQQQRNGTNAAWKQPEEQPIINHTKYSSNNISAPAGIITSAPSSSAEIVSVGQIGNFGYGSLPMEKSFRDCSISAGGNTGYAGSAINHNLGWMGVDPYSSAYTNFFDKIRPTEEETMEEEGQENGSPEIETLPLFPMHGEDIHSGYFNLKSNSSHYAGGWYQTEEGYFNNGSRASLELSLKYPDFA

SEQ ID NO: 5 - DNA, 888 bp, Glycine max
atggaacctcaacaacaacaacaacaagcacaagggagccaacaacaacaacaaaacgaggatggtggcagtggaaaaggggggtttctgagcaggcaaagtagtacacggtggactccaacaaacgaccagataagaatattgaaggaactttactacaacaatggaattagatccccgagtgcagagcagattcagaggatctctgctaggctgaggcagtacggtaagattgaaggcaagaatgtcttttattggttccagaaccacaaagctcgagaaaggcagaagaaaaggttcacttctgatcataatcataataatgtccccatgcaaagacccccaactaatccttctgctgcttggaaacctgatctagctgatcccattcacaccaccaagtattgtaacatctcttctactgcagggatctcttcggcatcatcttctgttgagatggttactgtgggacagatggggaattatgggtatggttctgtgcctatggagaaaagttttagggactgctcgatatcagctgggggtagcagtggccatgttggattaataaaccacaacttggggtgggttggtgtggacccatataattcctcaacctatgccaacttctttgacaaaataaggccaagtgatcaagaaacccttgaagaagaagcagagaacattggtgctactaagattgaaaccctccctttattccctatgcacggtgaggacatccacggctattgcaacctcaagtctaattcgtataactatgatggaaacggctggtatcatactgaagaagggttcaagaatgcttctcgtgcttccttggagctcagtctcaactcctacactcgcaggtctccagattatgcttaa

SEQ ID NO: 6 - protein, 295 aa, Glycine max
MEPQQQQQQAQGSQQQQQNEDGGSGKGGFLSRQSSTRWTPTNDQIRILKELYYNNGIRSPSAEQIQRISARLRQYGKIEGKNVFYWFQNHKARERQKKRFTSDHNHNNVPMQRPPTNPSAAWKPDLADPIHTTKYCNISSTAGISSASSSVEMVTVGQMGNYGYGSVPMEKSFRDCSISAGGSSGHVGLINHNLGWVGVDPYNSSTYANFFDKIRPSDQETLEEEAENIGATKIETLPLFPMHGEDIHGYCNLKSNSYNYDGNGWYHTEEGFKNASRASLELSLNSYTRRSPDYA

SEQ ID NO: 7 - DNA, 897 bp, Camelina sativa
atggagccaccgcagcatcagcatcatcaccatcaagccgaccaagaaagcggcaataacaacaagtccggttctggtggttacacttgtcgccaaaccagcacgaggtggacaccaacgacggagcagatcaaaatgctcaaagagctttattacaatagtggaatccggtcaccaacagcagatcagatccagaagatcactgctaggctgcgacagttcggaaagatcgagggcaagaacgtcttttactggttccagaaccacaaggctcgtgagcgtcagaagaagagattcaacggcacaaccatgaccacaccgtcttcatctcccaactcggttatgatggctaatgatcattatcatcaacatctccctctacttcaccatcatcatggcgttcccatgcagagacctgcgaactccgtcaacgttaaacttaaccaagagcatcatctctatcatcagaacaagtcatatcccagcttcaataacgggaatttaaatcatgcaagctcaggtactgaatgtggtgctgttaatgcttctaatggctactcaagtagccatatctatggatctatggaacaagactgttctatgaattacaacaacgtaggtggaggatggacggcaaacatggatcataatcatcattactcatcagcaccttacaacttcttcgatagaccaaaacctccgtttggtctagacggtcatcaggaagaagaagaatgtggtggcgatgcttatctggaacatcgacgtacgcttcctctcttccctatgcatggtgaagatcacataaatggtgccagctggaagtatggccaactggacggtcatgattgtcatggtagaggcccttgcgcttctcttgagcttcgtttgaactag

SEQ ID NO: 8 - protein, 298 aa, Camelina sativa
MEPPQHQHHHHQADQESGNNNKSGSGGYTCRQTSTRWTPTTEQIKMLKELYYNSGIRSPTADQIQKITARLRQFGKIEGKNVFYWFQNHKARERQKKRFNGTTMTTPSSSPNSVMMANDHYHQHLPLLHHHHGVPMQRPANSVNVKLNQEHHLYHQNKSYPSFNNGNLNHASSGTECGAVNASNGYSSSHIYGSMEQDCSMNYNNVGGGWTANMDHNHHYSSAPYNFFDRPKPPFGLDGHQEEEECGGDAYLEHRRTLPLFPMHGEDHINGASWKYGQLDGHDCHGRGPCASLELRLN

SEQ ID NO: 9 - DNA, 897 bp, Capsella rubella
atggagccaccacagcatcagcatcatcatcatcaagccgaccaagaaagcggcaacaacaacaacaagtccggctctggtggctacacgtgtcgccaaaccagcactaggtggacaccaacgacggagcagatcagaatcctcaaggatctttactacaacagtgcgatccggtcaccaacagccgatcagatccagaagatcaccgcgaggctgagacagtacgggaagatcgaaggcaagaacgtcttttactggttccagaaccataaggctcgtgagcgtcagaagaagagattcaacggcacaaccatgaccactccatcttcatctcccaactcggttatggtggctaatgatcactatcatcctctacttcaccatcatcatggtgttcccatgcaaaggcctgctaactccgtcaacgtcaaacttaaccaagaccatcatctctatcatcagaacaagtcatatcccaccttcaacaatgggaatttaaatcatggaagctcaggtactgaatgtggtgttgttaatgcttctaatggctacatgagtagccatgtctatggatctatggaacaagactgttcaatgaactacaacaacgtaggtactggaggatacggatcaaacatggatcatagtcatcattactcatctgcaccatacaacttctttgatagatcaaagcctctctttggtctagaaggtcatcaagaagatgaagaagaatatggtataggcgatgcttatctggaacatcgacgtacgcttcctctcttccctatgcatggtgaagatcacatgaacggtagtggtgctagctggaagtttgatggccgtgattgccatggtagaggcccttgcgcttctcttgagcttcgtctgaactag

SEQ ID NO: 10 - protein, 298 aa, Capsella rubella
MEPPQHQHHHHQADQESGNNNNKSGSGGYTCRQTSTRWTPTTEQIRILKDLYYNSAIRSPTADQIQKITARLRQYGKIEGKNVFYWFQNHKARERQKKRFNGTTMTTPSSSPNSVMVANDHYHPLLHHHHGVPMQRPANSVNVKLNQDHHLYHQNKSYPTFNNGNLNHGSSGTECGVVNASNGYMSSHVYGSMEQDCSMNYNNVGTGGYGSNMDHSHHYSSAPYNFFDRSKPLFGLEGHQEDEEEYGIGDAYLEHRRTLPLFPMHGEDHMNGSGASWKFDGRDCHGRGPCASLELRLN

SEQ ID NO: 11 - DNA, 588 bp, Arabis alpina
atggctactcatgtagccattagaagcattaacagcaccacattcagaacctgaacttgcatgatttaaattcccgttattgaagctgggatatgatttgttctgatgaagcagatggtgttcttggtcatgaagcttaacgttgagagaagcaggtctctgcatggaaacaccatgatgatgttgaagaagaggatgatgatgatggttatgatgataacgatcactggccatcataactgagttgggcgatgaagacgttggtgtggtggtcatggttgtgccattgaatctcttcttctgacgctcacgagccttatggttctgaaaccagtaaaagacgtttttgccctcgatcttaccatattgtctcagccttgcagagatcttctggatctcatcagcagttggtgaccggattccactattgtagtaaagatctttgaggattctgatttgctccgtggttggagtccatctcgtgctggtttgacgacaagtgtaaccaccagaaccggacttgttgttgttgttgccgctttcttggtcggcttgatgatgatgatgatgatgttgcggtggctccat

SEQ ID NO: 12 - protein, 304 aa, Arabis alpina
MEPPQHHHHHHQADQESGNNNNKSGSGGYTCRQTSTRWTPTTEQIRILKDLYYNSGIRSPTADEIQKISARLRQYGKIEGKNVFYWFQNHKARERQKKRFNGTTMTTTPTSSSPNSVMMASDRYHHNHHHHPLLQHHHGVSMQRPASLNVKLHDQEHHLLHQNKSYPSFNNGNLNHASSGSECGAVNASNGYMSSHVYGSMEQDYSMSNNNIGGGGWSNMDHNHHYSSPAYNFFDRPKPLFGLEGHQEEDQYGGDAYLEHRRTLPLFPMHGEDHINGGGGAIWKYRQLDGLELRLNSYAGVAPE

SEQ ID NO: 13 - DNA, 873 bp, Raphanus sativus
atggagccaccgcaacattaccatcaagccgatcaagaaagcggcaacaacaacaagtccgtctctggtggttacacgtgtcgtcaaacgagcacaagatggacaccaacaaccgatcaaatcagaatactcaaagatctttactacaacaatggagtccggtcaccaacagccgaccagatccagaagatctctgcaacgctgagacagtacggaaaaatcgagggaaaaaatgtcttttactggtttcaaaaccataaggctcgtgagcgacagaagaagagattcaacagcacaaccatggccacaccaacgtcttcatcgcccaactcggttatgatgatggctagtgatcaccatcatcatcatggtgttaccatccagagacctgctttggtcaacgttaagctcgaccaagaaaatcatatgtttcaccagaacagatcatatcccagctccaataacgggagtataaatcatgcaagttcaggcacggaatatggtgttttcggcgcttctaatggctacattagtaaccatatctatggatctatggaacaagactgttcaatgagctacaacagcgtaggtggaggatggacaaacatggatcataatcatcattactcaactccagcttacaacttctttgatagaccatcgcctctgtctggactagaaggtcatcaagaagaaggacaatatggtggcgattcttatctggaacatcgacgtacacttcctctcttccctttgcacggtgaggatcacatcaacggtggtggtggttccatcttgaagtacggacaatcagacggttgtgatcgttatggtagaggcccttgtgcttctcttaagctatgtctgaactga

SEQ ID NO: 14 - protein, 290 aa, Raphanus sativus
MEPPQHYHQADQESGNNNKSVSGGYTCRQTSTRWTPTTDQIRILKDLYYNNGVRSPTADQIQKISATLRQYGKIEGKNVFYWFQNHKARERQKKRFNSTTMATPTSSSPNSVMMMASDHHHHHGVTIQRPALVNVKLDQENHMFHQNRSYPSSNNGSINHASSGTEYGVFGASNGYISNHIYGSMEQDCSMSYNSVGGGWTNMDHNHHYSTPAYNFFDRPSPLSGLEGHQEEGQYGGDSYLEHRRTLPLFPLHGEDHINGGGGSILKYGQSDGCDRYGRGPCASLKLCLN

SEQ ID NO: 15 - DNA, 885 bp, Brassica napus
atggagccagcgcaacatcaccatcaagccgaccaagaaagcggcaacaacaacaagtccgtctctggtggttacacgtgtcgtcaaacgagtacaagatggacaccaacgaccgatcaaatcagaatactcaaagatctttactacaacaacggagtccggtcaccaacagccgaccagatccagaagatctctgcaaggctgagacagtacggaaagatcgagggaaaaaatgtcttttactggtttcaaaaccataaggctcgtgagcgacagaagaagagattcaacagcacaaccatgaccataccaacgtcttcatcgcccaactcggttatgatggctagtgatcactatcaccataaccatcatcatcatggcgttaccatccagagacctgctttggtcaacgttaagctcgaccaagaaaatcatatgtttcatcagaacagatcatatcccagcttcaataacgggaatacaaatcatgcaagttcaggcacggaatatggtgttttcagtgcttctaatggctacattagtagccatatctatgaacctatggaacaagactgttcaatgagctacaacaacgtaggtggaggatggacaaacatagatcataatcaccattactcaactccagcctacaacttcttagatagaccaatgcctctgtctggactagaaggtcatcatcaagaagaaggagaatatggtggcgatgcttatctggaacatagacgcacacttcctctcttccctttgcacggtgaggatcacatcaacggcggtggtggttccatctggaagtacagacaatcggacggttgtgatcgttatggtagaggcccttgtgcttctcttaagctgtgtctgaactga

SEQ ID NO: 16 - protein, 294 aa, Brassica napus
MEPAQHHHQADQESGNNNKSVSGGYTCRQTSTRWTPTTDQIRILKDLYYNNGVRSPTADQIQKISARLRQYGKIEGKNVFYWFQNHKARERQKKRFNSTTMTIPTSSSPNSVMMASDHYHHNHHHHGVTIQRPALVNVKLDQENHMFHQNRSYPSFNNGNTNHASSGTEYGVFSASNGYISSHIYEPMEQDCSMSYNNVGGGWTNIDHNHHYSTPAYNFLDRPMPLSGLEGHHQEEGEYGGDAYLEHRRTLPLFPLHGEDHINGGGGSIWKYRQSDGCDRYGRGPCASLKLCLN

SEQ ID NO: 17 - DNA, 885 bp, Brassica oleracea
atggagccagcgcaacatcaccatcaagccgaccaagaaagcggcaacaacaacaagtccgtctctggtggttacacgtgtcgtcaaacgagtacaagatggacaccaacgaccgatcaaatcagaatactcaaagatctttactacaacaacggagtccggtcaccaacagccgaccagatccagaagatctctgcaaggctgagacagtacggaaagatcgagggaaaaaatgtcttttactggtttcaaaaccataaggctcgtgagcgacagaagaagagattcaacagcacaaccatgaccataccaacgtcttcatcgcccaactcggttatgatggctagtgatcactatcaccataaccatcatcatcatggcgttaccatccagagacctgctttggtcaacgttaagctcgaccaagaaaatcatatgtttcatcagaacagatcatatcccagcttcaataacgggaatataaatcatgcaagttcaggcacggaatatggtgttttcagtgcttctaatggctacattagtagccatatctatggacctatggaacaagactgttcaatgagctacaacaacgtaggtggaggatggacaaatatagatcataatcaccattactcaactccagcctacaacttcttagatagaccaatgcctctgtctggactagaaggtcatcatcaagaagaaggagaatatggtggcgatgcttatctggaacatagacgcacacttcctctcttccctttgcacggtgaggatcacatcaacggcggtggtggttccatctggaagtacagacaatcggacggttgtgatcgttatggtagaggcccttgtgcttctcttaagctgtgtctgaactga

SEQ ID NO: 18 - protein, 294 aa, Brassica oleracea
MEPAQHHHQADQESGNNNKSVSGGYTCRQTSTRWTPTTDQIRILKDLYYNNGVRSPTADQIQKISARLRQYGKIEGKNVFYWFQNHKARERQKKRFNSTTMTIPTSSSPNSVMMASDHYHHNHHHHGVTIQRPALVNVKLDQENHMFHQNRSYPSFNNGNINHASSGTEYGVFSASNGYISSHIYGPMEQDCSMSYNNVGGGWTNIDHNHHYSTPAYNFLDRPMPLSGLEGHHQEEGEYGGDAYLEHRRTLPLFPLHGEDHINGGGGSIWKYRQSDGCDRYGRGPCASLKLCLN

SEQ ID NO: 19 - DNA, 882 bp, Helianthus annuus
atggaaactcaacaacaacaagcagatattcaagattttgggaacaaaaacagtaacacctatgcatgcaggcaaagcagtactaggtggacacccacaagtgatcagatcagaatactgaaagagctctactacaacaatggaatcagatcaccaactgctgatcagattcagagaatcgctgctcaactcagacagtacggcaagattgaaggcaagaacgtgttttattggtttcagaaccataaagctcgtgaacgccagaagaaacggttcactcctactgctcctccaccaccgtctcacttctccgatcatattaaccaccatcttcccaacgctgcccccatgcagattccgtctcaccaccaccactaccaccatcaagaaccaccacatgtctatgctcaccctcacaaactctacaccactcatcacattggggttggttcttcttcacaaggagtgatgggtgtagggtgtggctatggatctgttgctatggagaagagtttcaggaagtgttcaatatcaccaccgggagagagtaaggccacaggaggaattggccggaatatcggttcaagatcacggataagtgtcgattcgtgttccttcttcgacacaattaagccaaagacatatgagatgtttgagaatcatgatcaagatgaagaacaaggagagccttcaactgagatcgaaacacttccattattcccgattcacgacggcaaccatcatgatttcttcggcatgaggacggcaaatctgcaattggagcaaggcactggaggttactacactggaggaagctggtatcggtctgatgagagggcgtctcttgagctcagtctcaactcatatggttattataactaa

SEQ ID NO: 20 - protein, 298 aa, Helianthus annuus
METQQQQADIQDFGNKNSNTYACRQSSTRWTPTSDQIRILKELYYNNGIRSPTADQIQRIAAQLRQYGKIEGKNVFYWFQNHKARERQKKRFTPTAPPPPSHFSDHINHHLPNAAPMQIPSHHHHYHHQEPPHVYAHPHKLYTTHHIGTHNIRVGSSSQGVMGVGCGYGSVAMEKSFRKCSISPPGESKATGGIGRNIGSRSRISVDSCSFFDTIKPKTYEMFENRDQDEEQGEPSTEIETLPLFPIHDGNHHDFFGMRTANLPLEQGTGGYYTGGSWYRSDERASLELSLNSYGYYN

SEQ ID NO: 21 - DNA, 795 bp, Populus trichocarpa
atggaacctcaccaacaacaaccaaatgaggataataacggtggcgccaaagggaactttctttgcaggcaaaccagtacaaggtggaatcccactactgaccagataagaatattgaaggaactgtactacatcaaaggtgttaggtccccaaatggagctgagattcagcagatctctgctaggcttagaaagtacggcaagattgaaggcaagaatgtattttattggtttcagaaccataaagctcgtgagaggcaaaagaaaagactcaccaatgaagtccccatgcaacaaagaactgcctggaaacctgaagattattactcttacaagtactccaacagtaataataatcctgggttttcttcggcttcttcatctgcaaataccggtgtggttactgttgggcagacagatagccatggatatggatcggtaaccatgcaggagaagaattcttgggactgttcagcaccagctggtggtagcaatggtgctggtagtggatccatgagcaatattaactatggatcaggggttgacattaactctcacagttcatcctatgctgtatttggtcaagaacaagaagcagctgcaaagattgagactcttcctctatttccaatgcttggtgaggacatcagtagctctttcaacatcaacaatatcaacccagacttttattacagtagcggctgtggctatggtgattatggcaatgacacttcttcccgtacttccctggaccttagtctctactcctacaatggccaaccacaagattattaa

SEQ ID NO: 22 - protein, 264 aa, Populus trichocarpa
MEPHQQQPNEDNNGGAKGNFLCRQTSTRWNPTTDQIRILKELYYIKGVRSPNGAEIQQISARLRKYGKIEGKNVFYWFQNHKARERQKKRLTNEVPMQQRTAWKPEDYYSYKYSNSNNNPGFSSASSSANTGVVTVGQTDSHGYGSVTMQEKNSWDCSAPAGGSNGAGSGSMSNINYGSGVDINSHSSSYAVFGQEQEAAAKIETLPLFPMLGEDISSSFNINNINPDFYYSSGCGYGDYGNDTSSRTSLDLSLYSYNGQPQDY

SEQ ID NO: 23 - DNA, 843 bp, Vitus vinifera
atggaacctcaacaacagctccagcagcagcagcaacaaaaccaacaacagccaaacgaggatagcggcagcagcaaaggcagttttctgtgcaggcaaagcagtacacgctggactcctacaactgaccagataagaatattgaaggacctttactacaacaatggagttaggtccccaagtgctgaacagattcagaggatctcagctaggctgaggcagtacggcaagatcgaaggcaagaacgtcttttattggtttcagaaccataaagctcgtgaaaggcagaagaagcgattcactactgatatgcccatgcaaagatcccttggaaatgccggttggagacctgatgatcccattcacaacaaatttcataccattcccactcctgggatatcttccccatcttcttcttcttcacccagtgtgcttgctgttgggcagatgggaagctttggatatggatctgtggagaggagttttacagactgttcaatatcagcaggtggtggtcgtggtggggttggtggatctataaaccagagcttcgaatgggttggcatggacccatattcttcatcttatgcactctttgacaagagaaaaacaatgggtgaaagcttcgaagaagagcaagaagaagaagcaactccggagattgaaacgctcccactctttcccatgcacgctgaggatatcactggcttttgcaacattaagcccgaatccgacgcctactactccggctggtacaggcccgccgacgccaagaccagttcccgcacttctcttgagcttagcctcaactcctacgccggcaggtccccggattccccctga

SEQ ID NO: 24 - protein, 280 aa, Vitus vinifera
MEPQQQLQQQQQQNQQQPNEDSGSSKGSFLCRQSSTRWTPTTDQIRILKDLYYNNGVRSPSAEQIQRISARLRQYGKIEGKNVFYWFQNHKARERQKKRFTTDMPMQRSLGNAGWRPDDPIHNKFHTIPTPGISSPSSSSSPSVLAVGQMGSFGYGSVERSFTDCSISAGGGRGGVGGSINQSFEWVGMDPYSSSYALFDKRKTMGESFEEEQEEEATPEIETLPLFPMHAEDITGFCNIKPESDAYYSGWYRPADAKTSSRTSLELSLNSYAGRSPDSP

SEQ ID NO: 25 - DNA, 879 bp, Arabidopsis thaliana; identical to SEQ ID NO: 1

SEQ ID NO: 26 - protein, 292 aa, Arabidopsis thaliana; identical to SEQ ID NO: 2

SEQ ID NO: 27 - DNA, 879 bp, Lotus japonicus
atggaacaacctccccaacagcagcaacaaaacgaagacggaggcggatcaagtgggggaaaaggagggttcctcagtaggcagtccagtactaggtggacacccaccacagaccagattcgcatcctcaaggagctctactacaacaacggaatacgctcaccctccgcagaacagatccagaggatctccgcaagactcagacagtacggcaagatcgagggcaagaacgtcttctactggttccaaaaccacaaagcccgcgaaaggcagaagaagcgcttcaccagtgagacacacttgctgcccaacccaattcagcagcaacagcgcaacggaacaaacgcagcttggaagcagccagaggagcaacccatcatcaaccacaccaagtactcctccaacaacatatccgcacccgcagggattatcacaagtgccccatcttcttccgcagaaatagtctccgtggggcagatcggaaacttcggatacggatctctgccaatggagaagtccttcagggactgcagtatctcagccggaggtaacacaggatacgccgggtctgctattaaccacaacctcggatggatgggagtcgacccatactcctctgcttacaccaacttcttcgacaaaatacgcccaacagaggaggagactatggaggaagaaggacaggagaacggctcaccagaaatcgagaccctgcctttgttcccaatgcacggagaggacatccactccggctacttcaacctcaagagtaactcatcccactacgctggcggatggtaccaaactgaggaaggctacttcaacaacggatcacgcgccagtctggagctgtccctgaagtaccctgacttcgcttag

SEQ ID NO: 28 - protein, 292 aa, Lotus japonicus; identical to SEQ ID NO: 4

SEQ ID NO: 29 - DNA, 909 bp, Medicago trunculata
atggaacaacctcagcagcagcagcaaccacagacccaacagcactctccaaacaacggaatcatggggtccagacagagttccaccagatggaccccaacaaccgaccagatccgcattctcaaagacctctactacaacaacggaataaggtctccaagtgccgagcaaatccagaggatctccgcaaggctcagacagtacgggaagatcgagggcaagaacgtcttctactggttccaaaaccacaaagccagagagcgccagaaaaagcgcttcacctccgacgtcaacgtcgtccctatcatccagcgcgcccccaacaacaatactatcataagtgccgccaactggaagcctgaccaccacgaacaacagcagaacattaatgtccacacaaaccactccacatacaacatctcctccgctggcctcagttctgcttcctgctcctcagcagaaatggtcactgtggggcaaataggcaactacggctacgggtctgtcccaatggagaagtctttccgcgaatgcaccatctcagctggatgctcatcatcccaggttggctcaaccataaacccccacatcggctggatcggacaccacgtcgacccatattcaagtgcctacgctaacctcttcgagaaaatacgccccaacgaggagatcatggaagagtacgaccagggacaggaaaacggttccccagagatcgagacactcccactcttccctatgcacggagaagacatccacggagggtattgcaacctcaaatcaaattcctccaactacggaggatggtaccaggcagaagacgcagggttcatgtacggaagtcgtaccacttctctcgagctcagtctgaactcctacggatgcaggtcccccgactacgccaattaa

SEQ ID NO: 30 - protein, 302 aa, Medicago trunculata
MEQPQQQQQPQTQQHSPNNGIMGSRQSSTRWTPTTDQIRILKDLYYNNGIRSPSAEQIQRISARLRQYGKIEGKNVFYWFQNHKARERQKKRFTSDVNVVPIIQRAPNNNTIISAANWKPDHHEQQQNINVHTNHSTYNISSAGLSSASCSSAEMVTVGQIGNYGYGSVPMEKSFRECTISAGCSSSQVGSTINPHIGWIGHHVDPYSSAYANLFEKIRPNEEIMEEYDQGQENGSPEIETLPLFPMHGEDIHGGYCNLKSNSSNYGGWYQAEDAGFMYGSRTTSLELSLNSYGCRSPDYAN

SEQ ID NO: 31 - DNA, 924 bp, Petunia hybrida
atggaaacagcacagcaccagcagaacaaccaacagcactacctccaccaacacctctccatcggacaaggaacaaacatcgaggacggcagtaacaagaacaactcctccaacttcatgtgcaggcaaaatagtacccgctggacaccaaccactgaccagatcaggatattaaaggacctctactacaacaacggagtcagatcacctaccgctgaacagatccagagaatctccgccaagctcaggcagtacggcaagatcgagggcaagaacgtcttctactggttccagaaccataaagcccgcgagagacaaaagaagcgcctcatcgccgcagccaccaccgataacactaacctcccaatgcagatgcagttccagagaggagtctggagatcctctgcagacgaccccatccaccacaagtatactaatccaggagtgcactgcccttcagcttcttcccacggagttctcgcagtcggacagaacggcaatcacggatacggagccttggcaatggaaaaatccttccgcgactgctccatcagtccaggcagttccatgtcacaccaccaccaccaaaacttcgcttgggcaggagtcgatccttattcctcaaccacaacctaccctttcctcgagaagaccaagcacttcgagaatgaaaccctcgaagctgatgaagagcagcaagaggaggaccaggagaactactactaccaaaggaccacctctgccatcgaaaccctgcctctcttccctatgcacgaggagaacatctcctccttctgcaacctcaagcaccaggagtcatccggaggattctacaccgagtggtacagagcagacgacaacctcgcagcagccagagcttccctcgagctctccttgaactccttcatcggcaactcctcctag

SEQ ID NO: 32 - protein, 307 aa, Petunia hybrida
METAQHQQNNQQHYLHQHLSIGQGTNIEDGSNKNNSSNFMCRQNSTRWTPTTDQIRILKDLYYNNGVRSPTAEQIQRISAKLRQYGKIEGKNVFYWFQNHKARERQKKRLIAAATTDNTNLPMQMQFQRGVWRSSADDPIHHKYTNPGVHCPSASSHGVLAVGQNGNHGYGALAMEKSFRDCSISPGSSMSHHHHQNFAWAGVDPYSSTTTYPFLEKTKHFENETLEADEEQQEEDQENYYYQRTTSAIETLPLFPMHEENISSFCNLKHQESSGGFYTEWYRADDNLAAARASLELSLNSFIGNSS

SEQ ID NO: 33 - DNA, 864 bp, Phaseolus vulgaris
atggaaccacagcagccccagggcagtcaaccaaacgaggacggtggaagtgggaaaggcggatttctctccagacagtcctccactaggtggactccaaccactgaccagatcagaatactcaaagacctctactacaacaacggaatcagatccccttccgcagaacagatccaaaggatctccgctaggctcagacagtacgggaagatcgagggcaagaacgtcttctactggttccaaaaccacaaggccagggagagacagaagaagaggttcacctccgacaacgtccccatgcaaagacctgcaccaacaaatgctgcacctccttggaaacccgaccaagaccccattcacaccaagtactccaacatctcctccacaggaatctccagtgcatcctcctcctcagtcgagatgatcaccgtcggacaaatggggaactacgggtacggaagtgtgccaatggaaaagtccttcagagactgctccatatccgccggaggatcttccggtcatgttggaataaaccacaacctcggctgggtgggagtcgatccttactcttctgcatacgccaacttcttcgataaaataagaccaaacgaagagaccctcgaggaagaagaagaggaggaggaggaggaagaagaagaggacggaggagcagaaattgagaccctccccctgttcccaatgcacggagaggacattcacggctactgcaacctcaagtccaacagttacaactacgacggcaacggctggtatcacagtgaggatggcttcaaaaacggcagtagggcctccctcgagctctccctcaactcttacaccagaagatcccccgacttcgcatag

SEQ ID NO: 34 - protein, 287 aa, Phaseolus vulgaris
MEPQQPQGSQPNEDGGSGKGGFLSRQSSTRWTPTTDQIRILKDLYYNNGIRSPSAEQIQRISARLRQYGKIEGKNVFYWFQNHKARERQKKRFTSDNVPMQRPAPTNAAPPWKPDQDPIHTKYSNISSTGISSASSSSVEMITVGQMGNYGYGSVPMEKSFRDCSISAGGSSGHVGINHNLGWVGVDPYSSAYANFFDKIRPNEETLEEEEEEEEEEEEEDGGAEIETLPLFPMHGEDIHGYCNLKSNSYNYDGNGWYHSEDGFKNGSRASLELSLNSYTRRSPDFA

SEQ ID NO: 35 - DNA, 3200 bp, Glycine max
agttttttagtagtattttaacgttttttgaaacacctaacattcttttaagatattaccttctgaattctaattttttatattttctttcaattttattattaatatatttatttattttctttgttatcttttcttaaaataaattatgattttattattttttttatcattttatatttttcacctacttcaacaaactaattttttagtttccggtttaccaactagcttgcctacttctagctagtttttttactagttttgacaaaactaactaaagtcaaaaagttaattagtagttgaatgttgaaaatatatcttattaaatcataaaatggttgataaaattatttattaaagtaactgaacaatataaaattacatggacatatttttatacaacttttaatttgacttttttctataaaaagaactataatatttataatgttagtattaaattaattttaaacatttgtagctttttatttatgaaatataaaaaaatctacataaacttattatatatcaccatcaatatcatatataataaaatggtaaaaatgagaaaattctatcatatgtaaaaaagttaatttttttttcttaaataaaaaagattaaaaaggaaaacttataaatgttaaagaacaaaaaagaataaatacaaaaagttataaaaactagtgttttaaaaaatataacttaaaatttttaataacttctaacattttttaaaacgttacttaaggtaacactttttaatatatcaacttctattttattatatatcactatcaatatcatatataataaaatggtaaaaatgagaaaactctattatatataaaaagttaaaaataatgaattttttccttatataaaatagattaaaaaaaattctaataaatattcaacaacaataacataataaatataaaaagttacaaaaaaaaactaacatttttaaaaatataactttagtgtttcaaaaatccttagagttgttaaataaaaacttatttaccaaatttttaaactagtaaaaaaattaaaaactaattaaaatatcttgttaaatatattttaaatagtgtataatttatcatgtaagataatattcttatttttataataattactttaaaaatcatatctaaaagatttttaatatgtaatattatatatatatatatatatatatatatatatatatatatattcataaaacatcattaaaagtgacattaaaaacatattaaaaatcacattaaagcacattaataacatttaatttcaatactaagaactctttcaattcttgaaccaattacacttgtcttaatgggggaaaaaaaaacaaactctatacttatccgatcggaaaaactgcaaaagagaagaagaaatgaatgggagtgacacgcacaaattaatttcaagataccagcacttagtagcaatttagtagcatttgtttggtagccgtcattcgttgcattgcaccgtcaactcgcaaaaaatttattagtagttttatacaccaaaaatatgctgcgtctctttctctctcccctctctatcaattacacctcttttgccctccattaaatgcaattgcaccctctcaatacgctctgcaattactcttcgctgccacattttcctccatttgttccccacttccctctcctccttcaatgcccttgtccctatctcttcttcttctcctcactttctctctgtaacacctcttcatgccatagcttctttttcttttcttttttaccatataagtaaacattttttttttcaaaactgtcccaaacccttccttcaaaacggtcatctcttttcaacccaaaacagatctacaccttcatcttctactcccactctcactggtaagttaaaaaaaatcttgtttgtaaaacttctgtcgcaaccagggtcactgcgtgaatctctgtaacattcatgttttttttgttaaggttgtctaaggtcattgtttttttttaaagaaaaaaaaaagaaactaactaatgaaactgtttggtacaatttttttttttttttttgtgagttctaacatttttcaggtgagtcacttgtagctagggctgtgagaaaaggaacgttattaggtctgcaagaaaaaaaaagaaaaatatcctgatatataggatatgcgttgtaggattttctccgagatcttcgtgggtgttatattttctttaaaaaagttttgattttgttttgcgaaaagacaagatcagataagggttacaatatttctttgctttttaattcatatattttgatatgatatatgcatagcgtatatttgtttcgaaattttgattaagtttttttctctttaatcttttttttctcttggaggtcacgtttgtatcactgagtttttttgtagtaacacacacacttactcgctttgacattgctatctgacagaaaatccaagggctcaacttcttaagctttttctctatccaagaacctcttaggagagagaaagtgatatatatagagagagaaagagtcaattctacatatacttgttggtggtggtttttgaggcatgtgaagtatgcaagccgttattatgatgattccggcgagaaacatgccttcgatgatagcaaggaacaacaacaacgttggagggttttttggatcatcttcatcacctttcactcttgcccaggtcggtgcttttaacttttcaccttctctttcaactcttttgactctcttaccttctcttttttttttttttcacaattgtccacctctttaatttttcacccttttttcattaaaatttttgaaacaaaattgacccatctcaaaattttcacttttttaacgatcagtcgatcacatttgcatcacaaattaaaccaaccagaccaaatatccttctcgatattacaaatccgcgtttccccaaaactgcgttatttttctccataaaaaagtcaaaagaaaaaaaaaattaaactttctttaaaaaaaacaagaaagaaagaaaagaaaatgttgatatgtttgttgtgtctttttctctgagagagaaccgtactatactacatgtgtttgaattgtgtttttgttagattgagaaactataatcctctctccggaaccttaaaagatccgtagcaataatcata

SEQ ID NO: 36 - DNA, 1547 bp, Glycine max
agttttttagtagtattttaacgttttttgaaacacctaacattcttttaagatattaccttctgaattctaattttttatattttctttcaattttattattaatatatttatttattttctttgttatcttttcttaaaataaattatgattttattattttttttatcattttatatttttcacctacttcaacaaactaattttttagtttccggtttaccaactagcttgcctacttctagctagtttttttactagttttgacaaaactaactaaagtcaaaaagttaattagtagttgaatgttgaaaatatatcttattaaatcataaaatggttgataaaattatttattaaagtaactgaacaatataaaattacatggacatatttttatacaacttttaatttgacttttttctataaaaagaactataatatttataatgttagtattaaattaattttaaacatttgtagctttttatttatgaaatataaaaaaatctacataaacttattatatatcaccatcaatatcatatataataaaatggtaaaaatgagaaaattctatcatatgtaaaaaagttaatttttttttcttaaataaaaaagattaaaaaggaaaacttataaatgttaaagaacaaaaaagaataaatacaaaaagttataaaaactagtgttttaaaaaatataacttaaaatttttaataacttctaacattttttaaaacgttacttaaggtaacactttttaatatatcaacttctattttattatatatcactatcaatatcatatataataaaatggtaaaaatgagaaaactctattatatataaaaagttaaaaataatgaattttttccttatataaaatagattaaaaaaaattctaataaatattcaacaacaataacataataaatataaaaagttacaaaaaaaaactaacatttttaaaaatataactttagtgtttcaaaaatccttagagttgttaaataaaaacttatttaccaaatttttaaactagtaaaaaaattaaaaactaattaaaatatcttgttaaatatattttaaatagtgtataatttatcatgtaagataatattcttatttttataataattactttaaaaatcatatctaaaagatttttaatatgtaatattatatatatatatatatatatatatatatatatatatatattcataaaacatcattaaaagtgacattaaaaacatattaaaaatcacattaaagcacattaataacatttaatttcaatactaagaactctttcaattcttgaaccaattacacttgtcttaatgggggaaaaaaaaacaaactctatacttatccgatcggaaaaactgcaaaagagaagaagaaatgaatgggagtgacacgcacaaattaatttcaagataccagcacttagtagcaatttagtagcatttgtttggtagccattgagaaactataatcctctctccggaaccttaaaagatccgtagcaataatcata

SEQ ID NO: 37 - DNA, 3300 bp, Arabidopsis thaliana
taacaatgataagctacattgagtgtatcagttctaaaactttatagtatgctacaatcaatttttctaagtaacaacttcaagcaaggaatcacacacacacagtggtacataataaacttgattttaatatcatatgatcagcatcattaacggaataagttaagtaattcgtcatccatactactaagtcatattaaaatcataatcaaacttaaaagccgattagaaagagagcaaatatatctaaaaattcacgaggaagacgacaaatgcaaggaaacacagctagtattattaaacttaatagatattggatgaatgactgcataatatatatcacattaaaagtggacataaatttgcatatgtgtaatgtacctctccacaattaatcgcggaccatttattttactattacaagtcaagtaactttatattgttgatccataattcttttcgaacataaaatcatatacttaggccattttcaactgtcaaaactcgaatccgagaaccaaatttcaccattttccaaaaatgatgagtgtcgaccaaatggggtactactgtctaatcaggaacttgtgaacaaattttcaaccttttccaaataagacgagtgtcaaccaactttttccaaccaagagatattgggttgctacacaaatacttaatagccattgcatatttatgcatatgcaaatgcagggtcgtggcgtcagaaagaaacataggaccctcaacatatttaatattttgggagctatatttgactatttcatattagaaaataataataaaaaagtgttggttttatatcaaattgtaatttacgaaaaacttatgcttttgcgcaatgatttttgtaaagtatctactatgtttagtgtttacattgattagtaggctgccgttttttttcttgtgtattatgtactatatatgaatatgaacatttgtaaaagtgaatcttgtcattttcttgttgaaaacatatatagtatgtgcaaacaaagcataggttaatccaataccacacaaataacacgtcaggtaaatccaataataaatcgtatgtgcatgtatgtgtattcatgtatgttacatgaatgtctgaatcagtcagtgtacgtatatgatgtaggtgatgtaaatcttaatgtatgagctgtttcttggaccatggtccacaatggatattgctccccaactacattagtcaatcgactggccaatttttaattaagataattaatccaaactaccattaaatataactttgaccttttttctattcatttttagatattattggaacttacgtagtttacatgcatctcatccctttcttttgctccttgaaagtgggtccaatcacaaaaaatgatcttatattttgtattttgtattttaaaaactcataattatataggttcaaaaatttaattaacatcagtgtatactataattactactctagccaacaagataaattcattttgacatcagccaaaagataaaaatttggttaaaaactattggattagcttttagtatttaatattttatgtactgattaaatacgaatttagaaatctaggatataagtgagggtgtataataagggaggggtggaccattaatagcgatgtgcaattaaaaattatgattaagaatctaggaaatttgtagattgcttagttatttttatggcgatcgtcgtgtcaatgtcatggattttgaaactttaaattaatctcttaaattagcacctacctttgaattttatagaatctttttattttatatgtttaattttatagaatctaactagcttattttgagattaaattgtttagttacttttataacagtataaatgtataatgaggacctaagaatgtagtcctgtaatgttcttgctattctacttaatctcatcaccaatcaaccatcaaaagaagctagtactaataaaacctgcaggtattcgaataataattaagctcaaacactatactaatttatggaggattatatattcaatgaattaggaacctcatgatggacattattgactgatataatgtgtatactaattgtgagtatttaaaaaccatacaaagcatttatatgtccacatatattggacacacatgcaatcaatgttcaatatgctccacacacagaaataaaaatactctttctgatcatatgatacatcatacatatactaaaaaaatctaaaatgaactataaccacaagcatatataataacaatgaaatggtaatgtttcttcatttttatttgttcaaattcttattcggttgttttttcttaccctacgagaatccgtgaggtcaaagggaaacagtgattttttttttgtattttgttttttaaattgatgaactgtaaaactctctctctagaaaaatatataagtagtagtatgaattttctctcactaaaagcattaatggacctttcgataatcataaatgcaatgcaccctctctatgcatttcgcaataactccttttccttctgccacatcctcttcctcacctctttctcttcttccctttctcctaagttcctcctccaccaaattctccatttatttcgttaactatcctccatttgttttcttctgaagagtgatatattctacctttctctggttaaagaaactccctgaatccaccggttatgtcttgaccggctataagcctataaactgatgccctaagacacctttttaggtttctcaataattctccgcatctatcttttcttctccacaagtaagagaaccagaaaaccagagaagaagccgagctagctagggtttcattgtgtgcacaaaagtaagatctctctctctaaccaatacttgtgtaatttgtctttgtttctttgagcaaatattgcatgtttgttcatattagccggatccgttttatattttttcatgatctacattttatctttattttgtttgtaaattaatgagttttttttttttttttctgtttttgtcacgatctaaaaaacaagcgttacaaagaagaagaaaaacctttttggagttagaagtgtaaaaggggtttcagtttgacgaattttccttagtagttgtgtaaaaaaaggccattgacttaatgtcaactctatatatctacacatttttttattaattagtttttgtttttttcccacttcatttacctttagtcaatgaatttttactgaaaacgttttttcaaggtcaatttcactgagttaaaaaaaa

SEQ ID NO: 38 - DNA, 6022 bp, Glycine max
tcgttgaaaacagaaaatggtgatgagaatgtatttggttggatttttgaaaacattttcagtgaaaatgaaaacagaaaataaccagaaaatgaaaataataaaatttcgttttcagcgttttcaattgaaaacaagaacctcattttggataaaatgaaaatgagatgaaaataaatgtaattttaagcaaatttaaaaatacaaaaaaagtcaatatatcataaattttcaatatttttatttcctaaaaacagaaagcaaaaagttaaaccaaacatatttttagaattctaatctttagaaaataaaaacaattttcaaaaaatgaaaataaaaaataaaaatataaaccaaacacacaatatttcagcttgtgagtgcaaaacatatgcacgtttttcatttaagtatttctacagataactagacgaattgaaagttgttataaattttacttcaacaaccaccttaaaagggacctccgcatgatgatgaacgccactagttagaccatctctaatctctctgcattcttgcatgataagagaataatgaataattctaacataaaattagcttacgacattttcgcctctattactaatttgctagtattttatctttatctacctagcttgcattctgcatatgaaatttgtggcatgtaattttattaatgctatttaaaccaatgaatatattgaagctgcttctatgaattttactttttaacctaacatcaaattaatgacaaagaaaaggttcaaaaaattattttgaagcactactcgatcagaaaatggttcaatgaaatataaatgcatagctacagtggtgaactaagatctataatctctatatatccttatatattctttcattgatattcctcttaaaagtacatccaattgattgaagccttatctttacatgtataataaataataaaaaattagagcaataaacatatttacagattaactgacttaattaaagacaataaatatactaaacaaaaagaataagactataagagcatgtctcattattattaaaggtaattttgaaaataatatataaatttaggataaattatatatataaaaaggaacaaaaggcagcggttgattattaaattagttaatttgttgatgacttgtaaatcatgagaaactaaagaaaaataaaaaaacacctcaaacttccaccaaatcaccatatccaccgacagccaaatcaagtcataaaatgtcgatgaacctccccatctaccttgatcatgagtttgggattcaattgtagtgcattgacacctcgctttcaaagcaccctccagcctaatttgtagagccagtcaaacttgattctctacttttacctttatttaaaaaatcgtgcttaatatataatgcaagtttatagtatacccattccctttcttcacaaaaaaaaaaaatgaggaaatagaacattaagtactaggaatagacagagaagtctttcttaagttgggactgggatctcccgatctggtgggcggtactgtagcttaataaatctgactggggctattaggtggtgttttgtttgggagtttatttttttattttttatttttaaatttttaagatttataagatatgtatcaataataaattactttaagtttaagatatcatgatattttttgtttttcagaaaaggctaaaaatattgattttttgttttcagttttggatctatttttaaaagaaaatatttttaaaattttaaaaaaatacatttttattcttattttttttatttgaaaataaaaacaaaaaaacactcaaatcacgcatcattctagattttgagtgtctttttttctcaatgacaagagactattaatattttttagttcacttggtcataaactaattccactattagattttgagtgtgtgttaataaaaaatatttattaatcaacaatttttttatcaacaaatattaattttattaatagagagaatcaaattcacaattttttttaatcattcaacccacctcatatctcccaaatctatcaccagattaaatctttctaccatataagaatcaaatttaaataaacacaattattatttagtgactaattttgtcttctaaaattagtatataagaaaatttcatatttaacagctccaataagtctcactatgattatataccaaaattaaactcttagaagaattgttactgaaatcattaatatatatttttatggagaaaccattaaatttcaaaagagtctttctattataaattataatttataaatatgcttaatcaatatttcgcactaataaataatagaatgtttgcttataattaatttaatttgcgacgctagggttgagaaatacaggagttaaaagaagttgttgagttcagtggacctaggtcacaaaataaaagttaaattaagcatgaatgatatcgcgctctaactctcttctgttcacgtatatccatttacaccagtcgtccctccataaatgcttctacaccctctgcaataactccatgctgccaaaccttctctcacttgttctatttatctcctcctgcgttgtttcgttctgtctctattttgctttggcccaaactaaaactccatcaactactccttcacttccctaattccccccacacccattcttgtttctaccgttccagtcatcatcaacataactaattaaggtttacaccactatcaaacgcttaaggtcccctctcgcatatacgcgtgtttaattttagctttgacttgctttgctttgcttagcttagttaatttctgagtgagagaaaggggtaacggctacgtcccccgcattgaaattggttacttgactagcgtaatcatctgttttgtcaaacctttcacactctctacccttattttgtcttttctgatttccctagcttttgtcttttggggtggcaagttttgcgtgtaagataagagtattaaggccaaccaaggccaggtaaagtcaccagtgcctctttgcaaccttaacataagaatgaatctccaaacaaacacttgaaagtgctgcatatcgatcagagacaaaacagcggcacgagctggtcgatgcttttatcagtttcagctttgcgagacggttccataaatcccaattgcaagtaccatcaaactttacagagggaaagcggtcgattcattgctgtcatcttcgtggttaatctaacaggtgatcacttccctaatttcttattttctctcctaattaaacagagatagaacaccttttcttttttgagttgaacagcaatttgactaaatggtaaaacttgtacattttctttattctcgatggggagatctggcttagaaattttttacatatagaactccgattattaatcgttgttgttgttatcaaatttgttcaatttaatgctttattgccaacaaattaagtttagtctttttgagtaatgtgagtacttttctaagcatctaataataagctattgaagctcaatttgcctaaagcaccaaacttaatgctttattattttttgttttataggatacttttacttactttataagaattacaaaataaaatttagttagtgattttatatttgtgaaacttttatattttttaaatattctgtaaattattaaaactctattatcttattacagtatttgtttttatgataaggaagtggaaggaaaatgaaaagaaactatattatttttttaatgtttatttgagtgggaaaaaaagtttcaattctaaggcccatgagaaaatataattccttccctcccaaatttggcatgaaagggttgaggggaaaaatgatctcttactcatttttatttttgtttttttaatatatatatatatatatatatatatataacatgattttttatataaaaaataaatgatttcaccttatgaaaaatagttaaatataaaaagtttgtcttttaaagttaattgtattttttttaattagaatgataaatataactttttttgtaaggcctgtggctctttcgtgcttccataagcatcactatgagactaacttaaacagttagcccttttcccctttccccctttttcaaatatgcaaaccgaactcgtctatttattttcacttatctaaataattacaggaaaaattctctacgtttttcttatttccatatatcaaaataatacattttttctattcttttaatattttgttttttatctttcttatttttttctctattttatttctaattcaaatagaacattaatttgtttctatcgaatctttgttacccataataaactgtgtgtagtgtatacttgtaggttttttttttttaaaaaaaaatccttctgtctgctcaattaacaaataattctaaatcatttaatattctcttactaattttcctacattctttatatgtaaatgttctatatcttcaaacaaaatatcccggtatacattaactaataaccgaatactctctctccgtcttaagtatcgatctagattaatttatccagataaaaaaaaagttaatacacgtatgaaaaaataataattttacaaaattaaatttattaaataaattaaaaaaagtactattggtattacattaaaaaactaaagtgaaacttactaaaagagaataattttaaatttgacttctggatatataattgtattaaatagttgtatacataatttctatccttgtacaaaattgtctataataaaaaaattcatgtgatttataccaattttttcccatacccatatatattaatcttgtaaaatgtttaggatatataattaatatttttaactagaactagaatttgaatttttacttaagtaaaaaaaaaactcattttagaattaaaatcacaattattatagcataactaaaatcaacccttcccaattatattttggaaccaattgaccttaatctcaattcaatttgtaaaaaaaaaaagcgtattaaatagaaaaaaatacattaatattttaaaatataagcaatatatttaatacatttttcatttaattaaagaagaagattagtaagaagatattgtaagaaaaattgtaattattgtttgtttttattttttttatgcaatagaaataatagattttatatgattatagaaataataaatttaaacttaagatttcgtgcaaaaatttcaaattctctcacctcattacatgaaatatagtatatcttttatttttttcattttgtgtgcaagttaaagaacattaattacattaaacaatattactatcattgttcgtatttataaaatctaattaaattaaaaatacatctttattcattactatttccgttcttatttataagatccaaattattaaaaaaacaatttaaatatttaattgaatatgattgtttggtacatccttaattgaatatgtttaataatttcttaagaaatgtgtggataatagttaacatgaggcttattttctttttattaatgctaatacttattaaattatatattttcatatttttgagatgccagatgtattggatttttaatttttaatacattttacaaaatgtacatagaaagtcaatataaataatataattaatttaaaagaaatagcattgctcatttactattttactaaaaatattaaatttttgccttatgtagttatgaacatttaatgtaataataaactaattctaatgtatattatattgattattgaacttctttaaaatatattcttaagggccctcgctatatagggctacacaaactacactcttcttggtcgatctcccacatttttctctacccctcgcgcgtgttaaattttttgaaatcctggttttgcagagaagctatagagaagaagattgcggcttgtgaacttaaggatttaagtgaagtca

SEQ ID NO: 39 - DNA, 5966 bp, Glycine max
tcgttgaaaacagaaaatggtgatgagaatgtatttggttggatttttgaaaacattttcagtgaaaatgaaaacagaaaataaccagaaaatgaaaataataaaatttcgttttcagcgttttcaattgaaaacaagaacctcattttggataaaatgaaaatgagatgaaaataaatgtaattttaagcaaatttaaaaatacaaaaaaagtcaatatatcataaattttcaatatttttatttcctaaaaacagaaagcaaaaagttaaaccaaacatatttttagaattctaatctttagaaaataaaaacaattttcaaaaaatgaaaataaaaaataaaaatataaaccaaacacacaatatttcagcttgtgagtgcaaaacatatgcacgtttttcatttaagtatttctacagataactagacgaattgaaagttgttataaattttacttcaacaaccaccttaaaagggacctccgcatgatgatgaacgccactagttagaccatctctaatctctctgcattcttgcatgataagagaataatgaataattctaacataaaattagcttacgacattttcgcctctattactaatttgctagtattttatctttatctacctagcttgcattctgcatatgaaatttgtggcatgtaattttattaatgctatttaaaccaatgaatatattgaagctgcttctatgaattttactttttaacctaacatcaaattaatgacaaagaaaaggttcaaaaaattattttgaagcactactcgatcagaaaatggttcaatgaaatataaatgcatagctacagtggtgaactaagatctataatctctatatatccttatatattctttcattgatattcctcttaaaagtacatccaattgattgaagccttatctttacatgtataataaataataaaaaattagagcaataaacatatttacagattaactgacttaattaaagacaataaatatactaaacaaaaagaataagactataagagcatgtctcattattattaaaggtaattttgaaaataatatataaatttaggataaattatatatataaaaaggaacaaaaggcagcggttgattattaaattagttaatttgttgatgacttgtaaatcatgagaaactaaagaaaaataaaaaaacacctcaaacttccaccaaatcaccatatccaccgacagccaaatcaagtcataaaatgtcgatgaacctccccatctaccttgatcatgagtttgggattcaattgtagtgcattgacacctcgctttcaaagcaccctccagcctaatttgtagagccagtcaaacttgattctctacttttacctttatttaaaaaatcgtgcttaatatataatgcaagtttatagtatacccattccctttcttcacaaaaaaaaaaaatgaggaaatagaacattaagtactaggaatagacagagaagtctttcttaagttgggactgggatctcccgatctggtgggcggtactgtagcttaataaatctgactggggctattaggtggtgttttgtttgggagtttatttttttattttttatttttaaatttttaagatttataagatatgtatcaataataaattactttaagtttaagatatcatgatattttttgtttttcagaaaaggctaaaaatattgattttttgttttcagttttggatctatttttaaaagaaaatatttttaaaattttaaaaaaatacatttttattcttattttttttatttgaaaataaaaacaaaaaaacactcaaatcacgcatcattctagattttgagtgtctttttttctcaatgacaagagactattaatattttttagttcacttggtcataaactaattccactattagattttgagtgtgtgttaataaaaaatatttattaatcaacaatttttttatcaacaaatattaattttattaatagagagaatcaaattcacaattttttttaatcattcaacccacctcatatctcccaaatctatcaccagattaaatctttctaccatataagaatcaaatttaaataaacacaattattatttagtgactaattttgtcttctaaaattagtatataagaaaatttcatatttaacagctccaataagtctcactatgattatataccaaaattaaactcttagaagaattgttactgaaatcattaatatatatttttatggagaaaccattaaatttcaaaagagtctttctattataaattataatttataaatatgcttaatcaatatttcgcactaataaataatagaatgtttgcttataattaatttaatttgcgacgctagggttgagaaatacaggagttaaaagaagttgttgagttcagtggacctaggtcacaaaataaaagttaaattaagcatgaatgatatcgcgctctaactctcttctgttcacgtatatccatttacaccagtcgtccctccataaatgcttctacaccctctgcaataactccatgctgccaaaccttctctcacttgttctatttatctcctcctgcgttgtttcgttctgtctctattttgctttggcccaaactaaaactccatcaactactccttcacttccctaattccccccacacccattcttgtttctaccgttccagtcatcatcaacataactaattaaggtttacaccactatcaaacgcttaaggtcccctctcgcatatacgcgtgtttaattttagctttgacttgctttgctttgcttagcttagttaatttctgagtgagagaaaggggtaacggctacgtcccccgcattgaaattggttacttgactagcgtaatcatctgttttgtcaaacctttcacactctctacccttattttgtcttttctgatttccctagcttttgtcttttggggtggcaagttttgcgtgtaagataagagtattaaggccaaccaaggccaggtaaagtcaccagtgcctctttgcaaccttaacataagaatgaatctccaaacaaacacttgaaagtgctgcatatcgatcagagacaaaacagcggcacgagctggtcgatgcttttatcagtttcagctttgcgagacggttccataaatcccaattgcaagtaccatcaaactttacagagggaaagcggtcgattcattgctgtcatcttcgtggttaatctaacaggtgatcacttccctaatttcttattttctctcctaattaaacagagatagaacaccttttcttttttgagttgaacagcaatttgactaaatggtaaaacttgtacattttctttattctcgatggggagatctggcttagaaattttttacatatagaactccgattattaatcgttgttgttgttatcaaatttgttcaatttaatgctttattgccaacaaattaagtttagtctttttgagtaatgtgagtacttttctaagcatctaataataagctattgaagctcaatttgcctaaagcaccaaacttaatgctttattattttttgttttataggatacttttacttactttataagaattacaaaataaaatttagttagtgattttatatttgtgaaacttttatattttttaaatattctgtaaattattaaaactctattatcttattacagtatttgtttttatgataaggaagtggaaggaaaatgaaaagaaactatattatttttttaatgtttatttgagtgggaaaaaaagtttcaattctaaggcccatgagaaaatataattccttccctcccaaatttggcatgaaagggttgaggggaaaaatgatctcttactcatttttatttttgtttttttaatatatatatatatatatatatatatataacatgattttttatataaaaaataaatgatttcaccttatgaaaaatagttaaatataaaaagtttgtcttttaaagttaattgtattttttttaattagaatgataaatataactttttttgtaaggcctgtggctctttcgtgcttccataagcatcactatgagactaacttaaacagttagcccttttcccctttccccctttttcaaatatgcaaaccgaactcgtctatttattttcacttatctaaataattacaggaaaaattctctacgtttttcttatttccatatatcaaaataatacattttttctattcttttaatattttgttttttatctttcttatttttttctctattttatttctaattcaaatagaacattaatttgtttctatcgaatctttgttacccataataaactgtgtgtagtgtatacttgtaggttttttttttttaaaaaaaaatccttctgtctgctcaattaacaaataattctaaatcatttaatattctcttactaattttcctacattctttatatgtaaatgttctatatcttcaaacaaaatatcccggtatacattaactaataaccgaatactctctctccgtcttaagtatcgatctagattaatttatccagataaaaaaaaagttaatacacgtatgaaaaaataataattttacaaaattaaatttattaaataaattaaaaaaagtactattggtattacattaaaaaactaaagtgaaacttactaaaagagaataattttaaatttgacttctggatatataattgtattaaatagttgtatacataatttctatccttgtacaaaattgtctataataaaaaaattcatgtgatttataccaattttttcccatacccatatatattaatcttgtaaaatgtttaggatatataattaatatttttaactagaactagaatttgaatttttacttaagtaaaaaaaaaactcattttagaattaaaatcacaattattatagcataactaaaatcaacccttcccaattatattttggaaccaattgaccttaatctcaattcaatttgtaaaaaaaaaaagcgtattaaatagaaaaaaatacattaatattttaaaatataagcaatatatttaatacatttttcatttaattaaagaagaagattagtaagaagatattgtaagaaaaattgtaattattgtttgtttttattttttttatgcaatagaaataatagattttatatgattatagaaataataaatttaaacttaagatttcgtgcaaaaatttcaaattctctcacctcattacatgaaatatagtatatcttttatttttttcattttgtgtgcaagttaaagaacattaattacattaaacaatattactatcattgttcgtatttataaaatctaattaaattaaaaatacatctttattcattactatttccgttcttatttataagatccaaattattaaaaaaacaatttaaatatttaattgaatatgattgtttggtacatccttaattgaatatgtttaataatttcttaagaaatgtgtggataatagttaacatgaggcttattttctttttattaatgctaatacttattaaattatatattttcatatttttgagatgccagatgtattggatttttaatttttaatacattttacaaaatgtacatagaaagtcaatataaataatataattaatttaaaagaaatagcattgctcatttactattttactaaaaatattaaatttttgccttatgtagttatgaacatttaatgtaataataaactaattctaatgtatattatattgattattgaacttctttaaaatatattcttaagggccctcgctatatagggctacacaaactacactcttcttggtcgatctcccacatttttctctacccctcgcgcgtgttaaattttttgaaatcctggttttgcag

SEQ ID NO: 40 - DNA, 456 bp, Zea mays
aagcttgctttcacatctcctccggtcctcctccatgtgtacaccaaacaaaccaagaagaaaaaaatgcatggttttgttcccgatttataccttggagcaacccttccattctcttgaaattttctttgtcgccccttgaacttccccccatatgtccagtccagctacaaattaatggcgacgagcgatgaaacgcacggaacatatatgcctcagcaggcaaacgtcccagtcgtcgatctctggcacttaattaattgtttatattaattccaactcgttcgtgcaacggtgcaaacaaaacaagctgacgatgtcgagtcgctgtttccccttccaccttaattgcttttgcagccaaacctcctgctggacaaccagcagctccagctactgcagcagcaacacctgctggaccagatcccggcgacgacggcggagagcggcgacaac

SEQ ID NO: 41 - DNA, 3000 bp, Oryza sativa
ttaaaaaaatctggaaaaaagaagcgatttaaaaaaggaaacaaaaaagtgacgttaaaataggagatcttaaaaaaaagaaacgcgtagggatgcagctggtgcgcgcgccggctcctttcccttgcgcgcacgcgcgctagcatcccccataagtttaacccataaattatatttgcttcgttcgtttctcaatggcttgttagtcataggtcaatcaatcagagtctagaaaaagaggtaattttttccattgttgagaagatattaggagatactatttttttagtgtgaaatttgatatctatactagctatctcggtataaaaattactttaaatgtaaaatttagatgcctcaatatatatacttttttaagaaccgtataatttctcatagaaaaaagcaatgaagacggacatgactctcattagtagtgtacttttttttttcctaatccactatatagtgtaccattatccattaatttcttttatcttttacaactttgattttgagggatttgcatactgttttgaaaggttgattgtggttatttctcacttgattagatgcatgagtttttaaaataatttaatttcaagtagatacaatactcatgtatagatgatataattgtgtattattccctccatcctacgtatttttagtgtttaaaatttgttagcatttcttgagtattattttcctaacccacctaattaaccactgaaattatttctcactagtttgcatcgctgggcatgatatttcttattaaggatgtgtttagttcacattaaaattggaagtttggttgaaattgaaacgatgtgacggaaaaattaaaagtttaggtgtgtaggaaagttttgatgtgatagaaaagttggaagtttgaagaattattttgaaactaaacacggcataaagtgaactctcgggaggccgggggcatcgtgaaataaaaaagaaatgttggatatcagagaaggggctctcgtattgaaattttgttaagaggggtgagtttcgaatcgggatcggcgagcccatactttaagaggatatcttgaaataatttcaccgtaaccttaatttacgctaaaatccctaaacatatttatattcgtggacatggcgagtacatgccacgtttcttctgctagtaatttttcacataaatttttttttctcagcaagaaaggctggctatatactccagtgcagaaagagtgaaaaagactacaccaaacaagcatgaggcgtgtggaggcatgaaaacagtacgtacccagggcacagcagtgaaaacatcgatctcttcaccctgcatggtgtctccttaaaatctgatcgatcgactcccaaaaatataagtaaaatactcgagtcaaaatgcatcagtttgcatgcatagtgaaacagcagcaagctggtcttccacaggatactttttgacccattcctcctatacatgcatgtaattaatcacaaagttgcaaaaaatacaatactatgattgtgtatttgtgtgtactatatataaaacaaataaattaacctagtagtaactgatcagtatcgatcgagagtcaacaaaatatatgtagactacgacgatacgtgtgtgccttcctgttttcttttgttcttatctttgggccgcactatacgctgcatctatactaaacagtagtgaaaaatctacctctccaccactcaattattacgccggtctataataattcgttgtataaattacggggcaacagtgaattattcatgtgctcttgcgtgtaggattgccaaacaactgtttcatggtcagataaatgaaaaaaaagcgacaaattggtaacaataaggaaatgttaattaatttatgacatgtattactttcattaaaaatataatagtttctgactatacatgtatctcggaggtacataaccaaaaattcttagaggaagtataaaaaaaatgttttcttgttattggctacgaggtctcccaaaaatccaatgttgtacaaatactatattacatgtcaatttgaaattgtgttaataagtaaaaaaggacactccaatttctccatatcctcaattgaggaaatataaaaacaaaatttgtttaaaaaaatgtttcaggaagtataaaaaatgttttattgttcttggctatgaggtctcccaaaaatccagtgttgtacaaacactatattacatgtcaatttgacattgtgttaataaataataagtcaaaaaaggacactctaatttctccatatcctcaattgagggaatataaaaacaaaaattggaattgaaagttgaaaccatgcaccactagtctctctctctctctctctctctctctctccccttccatctctttctctcccctagcaattacactacgccttctccataaatgcgattgcaccctctcaacactccgcggcaataactccttcgcccccctctccacattctcttccacctgtgttccccttttcttctcctcttcttcttcctctcctcctcctgatcctgatcgagaagatctcaccttgatctcttgccgtgtgatctctagctctcgctagccctctgaaccttgcagtttgttgtttgcacccggtgaaacatcttcttttgtgcaggtaggagagacagcaaagcagagataagagttctatatttgcatgtagttcttgtcttggatctcactggctggctgtctcctctctgcagcaaggttcgttgggctagcttgtgtgctagatctgtttctacttgcgtttgcgttgcttggcaagcaagatatatatatatatatctatatctatctatctatcattctatctccctacatatttagagctagcactttgtgtgttctttgggtttgggacacactcatatacgcgtgttcatgagtggaaatggaaggagctgcaagggcaagaattagggtttgagatataggagtata

SEQ ID NO: 42 - DNA, 3000 bp, Arabidopsis thaliana
ttctgatcgaaaccgagaggataatttggaataagtaataacgaataatttgttaacaagtcgctttttatagattccttgtgagaaaacgtctttatcatatcaaacgatttttggtgagttattaatcttgtcgcagcattaagcatatatgatgccactttaggtcgtcggttacgttaattaacttacataaaattagatccaagaaaaaaaaatcttgcataagaaaagaagaaagaactagtttatttattaagctgtgagtttatcctaaaatatagtttggcttgtaaactagaattacatatagcagctgcaaaaaatgatggtgatgatgattttcacattgacaacaacaattatacaacgttatgatggtcgtcaatcgatatcaactcgaaaatataatttagaacttttgcatatacataggcacacacatatttttgtatgtatgaacatggtttagtgtatagttgatagtttaaagacattgattctttgaatggtcggagcttttagtgcgtttggttggtcggatcgccttgaaagctaaaaaaagacaactttgtccgtatgtgttgtcctagttttggagtaatttattttcgaccgttttagccattagcggaaaccacctaactctctctatcaaatgttctttagcgttggtccgttgcaaacatttgatcactgtattaataacatcgaccatacgatgctgttttgttcgtaccaaattcaccgtagtaaacgctgaaactttttttatttttttgtgtgtgtgcgcacaaaacgctgaaactagttaaaatataaatatattggataataagtataaagtacccaatatatttgtatctatttatattcgtgacatttgaatcgagttttacatggtatcggagtaacgagacaatcgataccatattattgctttgacctaccagttaatcaatatatacatatttcaagtctattaactcgtaagtctaatacaattagaaaaatgaaaaaaaataaaagaagaagatatatatggaaatattggcatttgtcttaataatgtaatcaatcatcaattgtagaagccaaaggcatctctagtgtcaacgaatttgaattgatataccaactaacatactttcaaaaccggtagattatacggtattggaagatgatgaaaagaagagtttatttctcttcaaaagttacaaattatataaatgtcatataccgtaagatgagatagttgaatattcacgtggtgtttatagtgtctacataggtaaaagacattaatcatacaatcgtattaacaaaattgattgtaaaaaaaaaaaaaaaagggttgattgtaagttcgtaacctctatgtggactgtgtggcccaaaccaatcggtcggaagctacaatactgtgtccgaatcctaaaaggctaaaaactgactcggaccagcttagagatcatatgaaattatggatagcggaatagctggcaacttcaatgaattctgaatttaaaacatttttttttatatatatagatgatttggcgattttcgaactggaatggtgaaaaagtggttgagtacactattagtttatttatttaaaaaatagagggaaattcaaatgaaaaaaaaagtttcatctacagaaaaaaaaacacgtcaaaattccaaaaaacttgaacgtcttgaacaacggtataaccgtataagaaagggaacttaaaacttaaacgtctacatgattgaaagggtaaaaatattcatattacaatggtataagaaaatggagaagccagaggagcaactccaaagaagaagatgcagcaagagagtgtacattattataattataagttggtatatatgtagttgctaaaaaaaaaaaagagtgtacaatattttctgaagaagcatcgagctggttaatatttaagacccaccaaaacctaccaacaatgttattctcatctctaagcaaaagtttgatctcatctttttttttaattttttttttgatgggtcctcttctacctctgcatctccacgtgctatacaagtggcctcgctgtatgtattatttaccactctcttattgttactaaaaacttgaatgtcacttgaatgtcacttgaatgcaaactatatatttaggtgaataccagatcaaatagcaataaataaaccaacaatttatgctaattaaaaacttgaaaaaacactttccattacctatgattttttaatccaatcttggggtttgatgcccataaaacgaagtcgaaaagagaaaagcgaccttaattgtaataaatgcagctattgacttctctatcaacttcaagtcttcaagtaactacaaatttaataatctccttagcttatcttagagaagcacaaaacaaaagggtctacgcttagtcttcctagattcttgatttgagtcttgatggccacttgctttttatgtctcaatcctaagagttgatacttacttagtattaatcaggtttcacattatctcagacctagcttgcatttttgatacaaacatgtcatgcaatacacataagcaacacgtaccgagtcattgattgaaaaacatgacctaaatagtaatacggactgagagagagtgatgaatcatttcatatgggagacagctttctcatacgcgtccatgcctttgcatgaaagattaaataattcaactctttcacttatcttattttaatttactttgcagaattccaagttttattgcaatcaccaggggtattaaatgggatagtgtaaatgcacctgcaacacatcaactaaccacacactcctccacctgtttgtatttacttcaaaaacttaattcaaaaatccctttgcttctttccttccctctatttataaaccctagtatccggtttttattctaccacacaataccatttgcaacaaacttctctctgaatctcagtgaattctcataaa

SEQ ID NO: 43 - DNA, 2546 bp, Glycine max
aaaatatattaaaagcgtgagtttatttgtttatactttttgcaatatctatatttttaataataaattaagatcttcaattttattatacaatatttcaagattaattgaaacattttttttttcaattaattcccgtccaaaattttcaattgtctaattattatgactgcttagtcttattaataaaaataataataaatgatgtatcatatcatattaagatttatcaactataatttaaattaaaataagtgtttttttaaaataaaataaatgattttataatttttttgatgcatttgtttaattttttatttaaaataagtaattttttgttttcttaaaaccaaccctatctgcttaatcatttttctaaattttttcaaaaaatttaaacaaattagttcataatattttatgactttaaataattcagtaccagcaactgcctcattgactttgcacttgccactgtcctgcctttgcacgaaaaataacatataaataacgcgtagcactgttttctatatctaaattagtctatataaaacataataattacataaatattcggagattttataaacaccgacaaaaaataaagtttaaagtttgtgatttttatgtcaatttctttttattcataagaattgaactcaaatataaaaaaaatttataacaacgtacaactaaattagactcattgatatttttatgtgaaatttaagtttaaccaaacaatatttatctagatatatgcataaagaaagagttttttttttagtttatacttagaccaatttttattttattttttatggaaacttagaacagatgttaatgagcagaaatatcaattatgaaataaaaatacaagtaattaatattttattttagttcttatagctcaattttttaataacacttttttggtccttgttctctaaaattatttaacgtaattacatttagatcttttaaaagtgttacaaaactgcaacggatagtgtaaattaaaaccgctaaaaagagatttgggtaaattttaatggtcataaataaatacaacaacaacgccttatcccactaggtgagtcggttacatggatcaacttccgcctaatcgtcataaataaataaagaaaagaaaacaagactttgttgtgccatcaaccatggccaaggcagaatcacgcgtgacaaactttcataaacgaattgagaaccttattggcattgggtcagagccatcggcgactgtgcttgttttgttgacggatttacatcatcaattccagttttgtaacaattttgaagaatatggatgtttgcattaggcaactttagacatccaataccaaaaggtttaacaattgtaactatatggaccaaaactcctattttaaacaataggtatcaaaagctaattaaacttttattaaaatagcaagcctaggaagcatacgtgtgtatatactaaaattgctgcatgagtgaactacacaaattcaatataattgttcaccatacttcagacaaaataatgttggcccagtcccatttaatgtaagactcaaaatctatgccagttgacccgaaccacacacaaacaatggtagaaatttggagtacgtatattggccacagtagcctactcaactgaaaagcaaccaacctatgaactttgctagctgtttccaagccatagcaattaaacttttccccttttacttttattttcttgaaatttttatgtaccaaggtgggttggaaatttcaaattggtaaatcaggttaattcctttctattagctaggtgcactcaatcttccatgtttatatacactataacattttatacagcatcaccttctgtatgtctatttattaatacagaaaagcatacacatactatgtattgattgccacagcctggtacaatcagccacaactgtttctcaaagtaacttgtatattgatattcatttatacctaagggtatgtctctatcctgctcccacaaatgtgggggaactgtgttgtagatttcactttcaagcgattgatattatatgttcaaggtaactcccctaattaatatattgaatgagacaatttgtgtaatgctaaataaggtttctatatcctaaacttctttagagtaaacatatgctaagaaaatggggtgtaccttcaattagtaccaaatttgcacacaagttgcttaagcttaattttgaaaaaaaataaaagggtttggagagagaggatatttggatgtattagacatgtgctcaaggttttttcagaaaatttcaggctatattacaagaagtagtgaattaatatcatgagtaaatgcaccctgcaaaacatcaactaaccacacactcttcccacccgctaatatttacttctcacttctgtgaactgttttatattccatgctttctcccttccccaaaccacacttcaaaatcctctggtaacccttattttatctattctctctctttcttttgtgttctaagcagctagaagca

SEQ ID NO: 44 - DNA, 2500 bp, Glycine max
aaaatatattaaaagcgtgagtttatttgtttatactttttgcaatatctatatttttaataataaattaagatcttcaattttattatacaatatttcaagattaattgaaacattttttttttcaattaattcccgtccaaaattttcaattgtctaattattatgactgcttagtcttattaataaaaataataataaatgatgtatcatatcatattaagatttatcaactataatttaaattaaaataagtgtttttttaaaataaaataaatgattttataatttttttgatgcatttgtttaattttttatttaaaataagtaattttttgttttcttaaaaccaaccctatctgcttaatcatttttctaaattttttcaaaaaatttaaacaaattagttcataatattttatgactttaaataattcagtaccagcaactgcctcattgactttgcacttgccactgtcctgcctttgcacgaaaaataacatataaataacgcgtagcactgttttctatatctaaattagtctatataaaacataataattacataaatattcggagattttataaacaccgacaaaaaataaagtttaaagtttgtgatttttatgtcaatttctttttattcataagaattgaactcaaatataaaaaaaatttataacaacgtacaactaaattagactcattgatatttttatgtgaaatttaagtttaaccaaacaatatttatctagatatatgcataaagaaagagttttttttttagtttatacttagaccaatttttattttattttttatggaaacttagaacagatgttaatgagcagaaatatcaattatgaaataaaaatacaagtaattaatattttattttagttcttatagctcaattttttaataacacttttttggtccttgttctctaaaattatttaacgtaattacatttagatcttttaaaagtgttacaaaactgcaacggatagtgtaaattaaaaccgctaaaaagagatttgggtaaattttaatggtcataaataaatacaacaacaacgccttatcccactaggtgagtcggttacatggatcaacttccgcctaatcgtcataaataaataaagaaaagaaaacaagactttgttgtgccatcaaccatggccaaggcagaatcacgcgtgacaaactttcataaacgaattgagaaccttattggcattgggtcagagccatcggcgactgtgcttgttttgttgacggatttacatcatcaattccagttttgtaacaattttgaagaatatggatgtttgcattaggcaactttagacatccaataccaaaaggtttaacaattgtaactatatggaccaaaactcctattttaaacaataggtatcaaaagctaattaaacttttattaaaatagcaagcctaggaagcatacgtgtgtatatactaaaattgctgcatgagtgaactacacaaattcaatataattgttcaccatacttcagacaaaataatgttggcccagtcccatttaatgtaagactcaaaatctatgccagttgacccgaaccacacacaaacaatggtagaaatttggagtacgtatattggccacagtagcctactcaactgaaaagcaaccaacctatgaactttgctagctgtttccaagccatagcaattaaacttttccccttttacttttattttcttgaaatttttatgtaccaaggtgggttggaaatttcaaattggtaaatcaggttaattcctttctattagctaggtgcactcaatcttccatgtttatatacactataacattttatacagcatcaccttctgtatgtctatttattaatacagaaaagcatacacatactatgtattgattgccacagcctggtacaatcagccacaactgtttctcaaagtaacttgtatattgatattcatttatacctaagggtatgtctctatcctgctcccacaaatgtgggggaactgtgttgtagatttcactttcaagcgattgatattatatgttcaaggtaactcccctaattaatatattgaatgagacaatttgtgtaatgctaaataaggtttctatatcctaaacttctttagagtaaacatatgctaagaaaatggggtgtaccttcaattagtaccaaatttgcacacaagttgcttaagcttaattttgaaaaaaaataaaagggtttggagagagaggatatttggatgtattagacatgtgctcaaggttttttcagaaaatttcaggctatattacaagaagtagtgaattaatatcatgagtaaatgcaccctgcaaaacatcaactaaccacacactcttcccacccgctaatatttacttctcacttctgtgaactgttttatattccatgctttctcccttccccaaaccacacttcaaaatcctctggtaacccttatt

SEQ ID NO: 45 - DNA, 2763 bp, Sorghum bicolor
cgaggtgctgtgcagatggaatggctactcacgctgacatttttcaggtgagagatcagagttggcaagggacgaaggaatggaggttgggatgggatgggatgggatgggatgggatgggggttgagagggactgacagcacgccaagctagctgaattaagcaaagttaaataagcttatgttggattagtagttggcatgttgggcaggaaagcaatccaggttaaaaattgcttgagggttgcaacctgcaaggctttgcttcagagtggctcaaatttgggtaggttttgatggcactcttttgattttgacaccaaatctttctcgcgacattaactatataatttcctattttaaccactttttagaaatgaaaattattagcacaataaagaagcatttgtaatgcgatatttttttttctgaattctcaagttttttttagatgaagatccttcaaagttgaaatttgttagtaccaaataagcccataaaattggaatgagcttaacgtgaatattccccggacaacctagtcatgacacttgttttggcagagtgaggacccatggtgtttggcattgcagcacagtaccaatctgccactgcctgatgagtgatgatacaagagcatcatcgaaaagcaacagtagatgacaccaggttttggaagggcagccagcagctttctgaccaccaccagacgtatatgaaacaaaagcaatcaggagagcatatcaggtttggtgagaaaagttgtgttaacaaatgaagactggaattccttgactgatcgcaagatgctaccagcagcaaacacttagaatgtaagctacaggcgtgtcaggagctaaagttttgcagataggaggtggctctcagcttctctctccgttgccttcaagtgaagcctcggcaaaaccgggcatgaaacacgcatcgcccgccccaattccttgtgcagtccaaaaggaccagaaccatttcacagtttcacagttgcattgacaggaagtaattcgaagacacgacataccgacgccagtaacaatataccataaaaagcatgggttgatgggttggtcatccaaacagaagattagctgataaacagacaaagggatgtgaaaacgaaccttttatggtagcaggtagcgatggcaatgctctatcttcttttgcagattttctcatgaatatcactgctaaagccagttttcatcaactccataaatcgaaagcgaaggggcataacatcagttcctccatactttctacccagtttcagtatttttgtgcggtcgtagctaaccgcagggagcattcttttggcacattcaactattggaattcgatgaccatgccaaacatcttaaaaccttccatcaaccgaaagtacaagtacaacatacaacggatatagatggaaactttcgttcataaagtttggtatcggcaatgtatttactaccacttaacagatgcatctctggcatccctgcagtaaagaagcagtaataggaacagaagaaaggttttacaaaatctcacgggtatcatgatcatcagttcattgccaggtgtgaccatagataaaccacagcaagatgtaaccaggatcatgcagtcccgcaccagtaggctaagtgctcgtccttgcgagatgtgctaaagagcccaccacatttcaggcagatgaagctgctcccatcagcaaacgcatccaggatgatctgcttccttccactctcagcaagaatgcaggcctcatcagaattcagcatatcgacagggtctgacccaggtccttgtgaagggttagtatttgttgactgagcctctgctatggcacattgggcaagcaaagaggcaagctcatcaacactaggagtggcctgcaatctctgcgcatagagttcacgcgcacggttcattgtctgcatgagcgcttgttcaccaccttgagatcttatggccaggagaacctgcatagtttcataacatgagaatcaatataacagatacagatgaatgggcatgaaatgagacaaatgagtctcaacgaaacaagataaagttcaaaaggttaataattaccacaaggctcatcattgggatctatacgaacaaaattgaaacagccttccagaaggaatcaaaatagaaattatgcatttcaatagaccagaatgcttgtcacattaccaatgtttgattcattaccagaacaaatcctacagtgttattatgagggacacatcaatcataagatcccacaggaaacagctaaggcataatcttatattgcgtaaatgttggtctaaaaaaatcagttacactaacataggcacatagctatggtgcaggcaggaagcactaatgacagagtgtggtgttgcagttgagaagtaattagcctactactccaatccacagagaagacgtgcatttcattcgatccatgtgatacatcaggtaatatgctatacatgtctaatccaaacaagatacggaaattccaatttaaccatcgcacactaatacatatagagaaagatttgtttaggcctatattgccctgtactcctgtgtaaatttagtacagtatactcaaataattttatgagggtaccaaacactaattgtgggctgtggctttcttcttcaacttttcccaaaccaaccttctacttttacccttactcaccaatataagggctcgacggtcatttttaacaggtcaaatccaaaatgattg

SEQ ID NO: 46 - DNA, 2567 bp, Oryza sativa
aggtagcataagaccatcatctttttccctttctaatatattatactacctctatattttaatgtatgacgccgttgacttttcgtccactatttgaccattcgtcttattcaaaaaatttacttaattatcatttattttattgtgacttgattcaccatcaaatgttctttaagcatgacataaatattttcatattttcacaaaaaatttgaataaaacaaatagtcaaacattagtaaaaaaaatcaatggcgtcctatattaaaatacggagggagtagtttttctaaagtatcctgtgaatcacacgcgcatatgtagcttgcatagttacacaaaatatgcctcctttaaatgccggagctaccaaaatgggctcataatagcctgaaattaagtagtcccttcaccgacaaaacactagttactactgtatcatcaacaacgacctgaatttacagtaggggagaaacagcttgaatataagctgaaataagttgaacccataccatcatcgctagtgaagagtttgattgcagataattagttatgcttagtataaaatgcaaaaatccatctgatctataacaataggtaaataaatcacatctctaatttatttacccatgctggttctttcagaaataatatttaaatactttgaaagttgcgttgaagacagtcggcccggatattaaggttcaactttatttcttttttcatcaattagtttatgcaattctgcccaatgatattgttactagtaaattttacagacagtagccaacactgtggatttatttattccataacccatgagagagatgtgataatatgcacacactactaattcagtacagtgatttaatatcacttatatctcatcatatcttggatgtcatgtagaataccaagtcaatgcaaaatctattttctttttttttcaccattaaatctttcaccaaatcataaaaaatcttatgtggcggctagctcatttaatcctatgtaaaacatcttaggtcgagtattaggactgtgccaacagaaatactatgtgctagcccagctttcaggggcccaacaatcaccaaagtaactctgcccttcggaaaattaaaggcagccactcagacacacagtgatatccagcaaatgcacgacggatcacatggagtttcagccccagggccaatcacatcttgcgcaagtacagccgttgctggtatcttcaaccattcctctattatctcctggcctggtcctgctcagctgcaactgtaacggttagttcagtcccatacttcttccgtttcacaatgcaagtcattctaccatttttcacatttatattgatattaatgaatctagatatatatatttgtctagattcattaacatcaatataaatgtaggaaatgttagaatgacttatattgtgaaatggagggagtatgtacgtatggtttcagagagttcgactgttccagaagttaagggcaatagacagttggatgcaggctactagtcattacctggtaattttctgcctttttttgtggtcattgtaagtaattcttgacaggagatcacacatgcatagctccatttcatctgcaatgtcagacgctgtcaagattaaggagtaggagttttgtttataggagggacgaaaatgtgagtgatggatagcatgatgaaatcgcaggtgcgatattgatgaatgactgcagcagcattacactaattgctatatatattttttatttaagagcagcaaggtctgtttgtaactaaaacagaaatgttttcaattaaaaaaaactaacagcacaaggtctacagcataccaagtaaactaacgctagctagaagcagccagatagatcagaaaaactcgaaaactttgcagcacaattctgtaatgtaatgtgctgataatgtatagcatgaaagactgcggcacaaatcagttccaagaaacttacaagaattaacaagcggaattagaccaaagcatcgctttttacacaaaaacaattgtaaaatcaaatttggtgcttccacataacaactgggccagggaatcttaccatactgtgcttccattaaattgagaaattcaattttgccaccacagcatgaaatccagctcgaggcatggttaagtgtactgagtaggtggcaagcaccgatccccattaaatcagcagactttcggggaggaaatccattctgcatggaaagaagactgccaatatccatggaagctaaaagtgccatggcctcgctctaacctacaaatttggacacagatttgagttaaagaactcacaatggaagcttcatcatgtgaattgaaagcgagcagatcaccgtcatgctgaactagctggacgaatcaaaccattaaatgatagacaactactaacagtgtcaatggaactgtagagcatctttcgcatgtatatataggcgcacaaaggcaattcagttcatcagctcaagcacctcaaccagttcagtcatccattctgtcttctctgcagatactgagagccaag

SEQ ID NO: 47 - DNA, 2500 bp, Oryza sativa
aggtagcataagaccatcatctttttccctttctaatatattatactacctctatattttaatgtatgacgccgttgacttttcgtccactatttgaccattcgtcttattcaaaaaatttacttaattatcatttattttattgtgacttgattcaccatcaaatgttctttaagcatgacataaatattttcatattttcacaaaaaatttgaataaaacaaatagtcaaacattagtaaaaaaaatcaatggcgtcctatattaaaatacggagggagtagtttttctaaagtatcctgtgaatcacacgcgcatatgtagcttgcatagttacacaaaatatgcctcctttaaatgccggagctaccaaaatgggctcataatagcctgaaattaagtagtcccttcaccgacaaaacactagttactactgtatcatcaacaacgacctgaatttacagtaggggagaaacagcttgaatataagctgaaataagttgaacccataccatcatcgctagtgaagagtttgattgcagataattagttatgcttagtataaaatgcaaaaatccatctgatctataacaataggtaaataaatcacatctctaatttatttacccatgctggttctttcagaaataatatttaaatactttgaaagttgcgttgaagacagtcggcccggatattaaggttcaactttatttcttttttcatcaattagtttatgcaattctgcccaatgatattgttactagtaaattttacagacagtagccaacactgtggatttatttattccataacccatgagagagatgtgataatatgcacacactactaattcagtacagtgatttaatatcacttatatctcatcatatcttggatgtcatgtagaataccaagtcaatgcaaaatctattttctttttttttcaccattaaatctttcaccaaatcataaaaaatcttatgtggcggctagctcatttaatcctatgtaaaacatcttaggtcgagtattaggactgtgccaacagaaatactatgtgctagcccagctttcaggggcccaacaatcaccaaagtaactctgcccttcggaaaattaaaggcagccactcagacacacagtgatatccagcaaatgcacgacggatcacatggagtttcagccccagggccaatcacatcttgcgcaagtacagccgttgctggtatcttcaaccattcctctattatctcctggcctggtcctgctcagctgcaactgtaacggttagttcagtcccatacttcttccgtttcacaatgcaagtcattctaccatttttcacatttatattgatattaatgaatctagatatatatatttgtctagattcattaacatcaatataaatgtaggaaatgttagaatgacttatattgtgaaatggagggagtatgtacgtatggtttcagagagttcgactgttccagaagttaagggcaatagacagttggatgcaggctactagtcattacctggtaattttctgcctttttttgtggtcattgtaagtaattcttgacaggagatcacacatgcatagctccatttcatctgcaatgtcagacgctgtcaagattaaggagtaggagttttgtttataggagggacgaaaatgtgagtgatggatagcatgatgaaatcgcaggtgcgatattgatgaatgactgcagcagcattacactaattgctatatatattttttatttaagagcagcaaggtctgtttgtaactaaaacagaaatgttttcaattaaaaaaaactaacagcacaaggtctacagcataccaagtaaactaacgctagctagaagcagccagatagatcagaaaaactcgaaaactttgcagcacaattctgtaatgtaatgtgctgataatgtatagcatgaaagactgcggcacaaatcagttccaagaaacttacaagaattaacaagcggaattagaccaaagcatcgctttttacacaaaaacaattgtaaaatcaaatttggtgcttccacataacaactgggccagggaatcttaccatactgtgcttccattaaattgagaaattcaattttgccaccacagcatgaaatccagctcgaggcatggttaagtgtactgagtaggtggcaagcaccgatccccattaaatcagcagactttcggggaggaaatccattctgcatggaaagaagactgccaatatccatggaagctaaaagtgccatggcctcgctctaacctacaaatttggacacagatttgagttaaagaactcacaatggaagcttcatcatgtgaattgaaagcgagcagatcaccgtcatgctgaactagctggacgaatcaaaccattaaatgatagacaactactaacagtgtcaatggaactgtagagcatctttcgcatgtatatataggcgcacaaaggcaattcagttc

SEQ ID NO: 48 - DNA, 2602 bp, Populus trichocarpa
aacagcctgtgctgtcaaagagaaaccattgtgtattttcttttcattacaaaatctaccatcttactcactagtacaagatctaaatactccaacaagagcttgatcttgttttcaatggtctggtgtaagacaccattaatttatttgaaatggggatatgagatataatcaaatagtggaggttgtgggctagcagggctcaaatctttatggtgtattggaccaaacaaaattggggcaggatatcattgttcttgggctcaatatttgttagcttgtccgatgagagaatgaataggaaggcaccccccccctgtgtctcttctcttccagatttaataaattagaggaaaaaaacttaatgtgccgctcgggaaatgaatcatttctagtggtttaagtcgggaccagctgaacggagtctctgaaaaaaaaaaaacgtagtcctgaattcaaacagcttaaagtctaagagataatgaaacacggtgagggttcaatcccatggcatggagcaagttgagacatgggttttgatcagttttattgaggttggaattgaatgtcacattcatcactcggggatgttgcagcaccagatggccttacaggaaaatcatgtctatgtgcttttgagcctacttctatagtttaatctcagcttgtcaaatgaagtcaacttgatcctacagtatcactgtatatgaacttgttctataatcttgtcatattggtggtgaattttttttctaatgaattttgtgaagaccatgttataaaaagactcctaacaatgcctagatcaccacaataaaatggcatggtgaagaaaaaaataaaattatctttaatatggcgagaaacatacttaaaaccaagaaaatgccaaatgaattttgggttgaagttataaattatgttatttacttgttaaataggttttctatgaaaagcttaaatgacatgactctattataaaaagcatgcatggaatggaagaaagtcaagtgttactcatttgaaagtaattagaagcattgactatatgcatgcagatgatcaagtaaggaccaaattagatgacaaaagcaaaaaataatctttgtgagctataatcaaaagtcaaaataatacaagtttcacaaccctaataaataaaaaatgatgattaatagaaatgtcgaatttgatgaagaaagagcatgaaattagaaggtagacgatgttgagaagtatgaatttctaccagtttttgatgaagagatataaagatcatcaataacttgttacacctccacaatcatcaataaactcaacttcacctttatcctcttcttcttttagtagaagttccagtagtggcagctcacttagttaatatagaaagatgaagagtcttgatgacttgtataagataattaatccaattgatgatgatctatcactatattgtcatcttgctacatgtaaatctttagtgtttgtaaaagaaataaatgatgaaaaatagagaattgctataaataaagagattgcatcaactgagaagaatgacacatgaaaatttgttcctagaccaaaaagaaagaagacaataggctaagaagaagcaacctatagtcacattattaacttgagaagatgaatatgtatctactacaacaagtgtttgtcattccatatggctaagaaaattattgaaagagttatgaatgccacatgagaagcctacaaaaatttatataaacaactcattagtcattgctttaactaagaatccaatatttcataactgaagtaagcacatacacacaagatttaatttccaataagattgtattacaaacaagaaagttgaagtcaaatatataaaaacacaagatcaagttatagatatttttataaagccactcaaatatgatgtttttgtcaagatgagaaatatgctatgagttataaagaaatcaattttaagaggggatgttgaaagtaaactagattttagtttttttgcaaaatagaagaatcggtcgatcggttcagaaacaattaaccaataaagacgacataatacattttcttatttgcctagaacctgaggtttataaataaaattttaatctaaggaataattaatatatgtaaagagaaaatctaaggaataataaaattgtttttttattgaatcctcttcttgttttttagttttacttattattttgctgttaataaactcctgccacacttattattattttttttttccaatataataattcatttcgtagtaaccttggcaaaacctccatggcaatggtggcaattcacacatcagagttcttaaaacgagagaacaatccattagcaagagtgagcttgggcatgtggcgggggttggattaattgcattatcgcatcagtgcaagtcattaatagcacaaattaatgctccggcaacaaatcaactaaccacatactccttcacctgctaatatttacttcactctgtcaactctatataatccccgctttcttcactgaagaatgcacctttcagttatatcccaacttacttctagtgttctccaagaatattgag

SEQ ID NO: 49 - DNA, 2500 bp, Populus trichocarpa
aacagcctgtgctgtcaaagagaaaccattgtgtattttcttttcattacaaaatctaccatcttactcactagtacaagatctaaatactccaacaagagcttgatcttgttttcaatggtctggtgtaagacaccattaatttatttgaaatggggatatgagatataatcaaatagtggaggttgtgggctagcagggctcaaatctttatggtgtattggaccaaacaaaattggggcaggatatcattgttcttgggctcaatatttgttagcttgtccgatgagagaatgaataggaaggcaccccccccctgtgtctcttctcttccagatttaataaattagaggaaaaaaacttaatgtgccgctcgggaaatgaatcatttctagtggtttaagtcgggaccagctgaacggagtctctgaaaaaaaaaaaacgtagtcctgaattcaaacagcttaaagtctaagagataatgaaacacggtgagggttcaatcccatggcatggagcaagttgagacatgggttttgatcagttttattgaggttggaattgaatgtcacattcatcactcggggatgttgcagcaccagatggccttacaggaaaatcatgtctatgtgcttttgagcctacttctatagtttaatctcagcttgtcaaatgaagtcaacttgatcctacagtatcactgtatatgaacttgttctataatcttgtcatattggtggtgaattttttttctaatgaattttgtgaagaccatgttataaaaagactcctaacaatgcctagatcaccacaataaaatggcatggtgaagaaaaaaataaaattatctttaatatggcgagaaacatacttaaaaccaagaaaatgccaaatgaattttgggttgaagttataaattatgttatttacttgttaaataggttttctatgaaaagcttaaatgacatgactctattataaaaagcatgcatggaatggaagaaagtcaagtgttactcatttgaaagtaattagaagcattgactatatgcatgcagatgatcaagtaaggaccaaattagatgacaaaagcaaaaaataatctttgtgagctataatcaaaagtcaaaataatacaagtttcacaaccctaataaataaaaaatgatgattaatagaaatgtcgaatttgatgaagaaagagcatgaaattagaaggtagacgatgttgagaagtatgaatttctaccagtttttgatgaagagatataaagatcatcaataacttgttacacctccacaatcatcaataaactcaacttcacctttatcctcttcttcttttagtagaagttccagtagtggcagctcacttagttaatatagaaagatgaagagtcttgatgacttgtataagataattaatccaattgatgatgatctatcactatattgtcatcttgctacatgtaaatctttagtgtttgtaaaagaaataaatgatgaaaaatagagaattgctataaataaagagattgcatcaactgagaagaatgacacatgaaaatttgttcctagaccaaaaagaaagaagacaataggctaagaagaagcaacctatagtcacattattaacttgagaagatgaatatgtatctactacaacaagtgtttgtcattccatatggctaagaaaattattgaaagagttatgaatgccacatgagaagcctacaaaaatttatataaacaactcattagtcattgctttaactaagaatccaatatttcataactgaagtaagcacatacacacaagatttaatttccaataagattgtattacaaacaagaaagttgaagtcaaatatataaaaacacaagatcaagttatagatatttttataaagccactcaaatatgatgtttttgtcaagatgagaaatatgctatgagttataaagaaatcaattttaagaggggatgttgaaagtaaactagattttagtttttttgcaaaatagaagaatcggtcgatcggttcagaaacaattaaccaataaagacgacataatacattttcttatttgcctagaacctgaggtttataaataaaattttaatctaaggaataattaatatatgtaaagagaaaatctaaggaataataaaattgtttttttattgaatcctcttcttgttttttagttttacttattattttgctgttaataaactcctgccacacttattattattttttttttccaatataataattcatttcgtagtaaccttggcaaaacctccatggcaatggtggcaattcacacatcagagttcttaaaacgagagaacaatccattagcaagagtgagcttgggcatgtggcgggggttggattaattgcattatcgcatcagtgcaagtcattaatagcacaaattaatgctccggcaacaaatcaactaaccacatactccttcacctgctaatattt

SEQ ID NO: 50 - DNA, 2134 bp, Setaria italica
tttggaccatgtttagttcctccaaaactcccaactttagcactatgcaaaaagaagattctccatcacatcaaacttgcggtacatgcatggagtactaaatgtagacgaaatcaaaaactaattgcacagttttgttgtactttgcgagacgaatcttttgagcctaattagtcaatatttggacaataatttacaaatacaaacgaaacgctagtgtgctacagtgctacaacagtaattttgcacctccaaactttggccaaccaaacaagatcctatatatcggagttcgttctacgacgacttgcactacatgccccgtttaaatgctcagctagtcagctaccaaaatgggctcataaagtcataatagcagcggactccttccaccgacaaactcccaccctcctctagtcacccgcagcatgccaacatgaatttcagctgaaacagagctgcaccaccacccaagcacgcaaacaaatttgagcaagtaaaattaattgcaccgcaagaacagtaaatgcaagtactgttagtatattcggccaatgagaaatgaacgcaggagagatgtttttcgtacatgtgctttcttgaaggacccctcgcatcaccactcatcaatggaactgcgtgttcaaaaatggcggccacagagcagcagccgctagcttccgtctgtccgggcccccgaactctctgtaaagctccggcagatccacaagagatcacatggcagcccgatctccccggggccaatctcctcttgagcaagaccagctgctggcctctcgcgtccttgtgcttcctccttgattggaaggcagcctggtgttaaaggtgagagcacagtaaatttggtttggtactccttccgttccaaattgtaggtcattttaattttttagtttataaatattattatgcacctagacacatgtttctgtagttgtcttcctgtaaggaaaaggaccttgcaaattgaacccatgtactgatggtcatttctgaacttcgcacatgaggtcagtacggtcagtccatgtcgtagtaattccgaaggaaactgcacatgaatgactcatgtatgatgtatattagtaaaatgctgccatgatgtgaaccagcaatacgatagcatgtgcgacgatgttgtacaaaacagaggaggcccttgtaaaagacagacggcattacattcaggggctaaaaacatggtaccatacaggtgagatatgatggatgaatgcgggcagcagcccactgcgactacagtatacgcactaaaacctcggcagatgcaatcagaataatacacagaaacgcagaggactatcagactatgcaccagtattctgacagagtataagcacacttttgaatatgcagcagtaaaagatgcagtgaaatcagttttaaagaagttaccagattttccagtaaagatatgagacttgtgatgaaatctggccaaatcctgtgcctttcagttggatcacaaaataccttcagccgctccatagttattcagaacaaactcgagttagatccctcgaccctctgtttcgctggaccagccaaacccatgtttccattaataagttcgatagattcggtatttcaattcagggatcagatcgccgaatccagctcgaggtatagttaggtacactgagtaggtgggaggcaccgattccgattaaatctgcagtctgggaatagaaaagatcctcattttctgtcaaaagatgcctgcccaaaatccacgaagctctaagctatcacagttcacagccttagtgcccttttcctttttttttgcacaatatttgtagaaaagaatttgggctaaaatactcagtaccttcattatgctagttgagagcaagcagatcactgccgtgacaagctggacaaaccaagatcattaaatgttggccaactactaacagtgtgatgaacatgtacacatctttgcacgcaatagcttcaatggaactgtggagcactgctcgaatgtatatatatgtgcctgaagggaactcagttcatcaactcaagcatctctaggttctcaaccagttcttaggccacatattcagtcttgtctgtagacgttgagagcaag

SEQ ID NO: 51 - DNA, 2056 bp, Setaria italica
tttggaccatgtttagttcctccaaaactcccaactttagcactatgcaaaaagaagattctccatcacatcaaacttgcggtacatgcatggagtactaaatgtagacgaaatcaaaaactaattgcacagttttgttgtactttgcgagacgaatcttttgagcctaattagtcaatatttggacaataatttacaaatacaaacgaaacgctagtgtgctacagtgctacaacagtaattttgcacctccaaactttggccaaccaaacaagatcctatatatcggagttcgttctacgacgacttgcactacatgccccgtttaaatgctcagctagtcagctaccaaaatgggctcataaagtcataatagcagcggactccttccaccgacaaactcccaccctcctctagtcacccgcagcatgccaacatgaatttcagctgaaacagagctgcaccaccacccaagcacgcaaacaaatttgagcaagtaaaattaattgcaccgcaagaacagtaaatgcaagtactgttagtatattcggccaatgagaaatgaacgcaggagagatgtttttcgtacatgtgctttcttgaaggacccctcgcatcaccactcatcaatggaactgcgtgttcaaaaatggcggccacagagcagcagccgctagcttccgtctgtccgggcccccgaactctctgtaaagctccggcagatccacaagagatcacatggcagcccgatctccccggggccaatctcctcttgagcaagaccagctgctggcctctcgcgtccttgtgcttcctccttgattggaaggcagcctggtgttaaaggtgagagcacagtaaatttggtttggtactccttccgttccaaattgtaggtcattttaattttttagtttataaatattattatgcacctagacacatgtttctgtagttgtcttcctgtaaggaaaaggaccttgcaaattgaacccatgtactgatggtcatttctgaacttcgcacatgaggtcagtacggtcagtccatgtcgtagtaattccgaaggaaactgcacatgaatgactcatgtatgatgtatattagtaaaatgctgccatgatgtgaaccagcaatacgatagcatgtgcgacgatgttgtacaaaacagaggaggcccttgtaaaagacagacggcattacattcaggggctaaaaacatggtaccatacaggtgagatatgatggatgaatgcgggcagcagcccactgcgactacagtatacgcactaaaacctcggcagatgcaatcagaataatacacagaaacgcagaggactatcagactatgcaccagtattctgacagagtataagcacacttttgaatatgcagcagtaaaagatgcagtgaaatcagttttaaagaagttaccagattttccagtaaagatatgagacttgtgatgaaatctggccaaatcctgtgcctttcagttggatcacaaaataccttcagccgctccatagttattcagaacaaactcgagttagatccctcgaccctctgtttcgctggaccagccaaacccatgtttccattaataagttcgatagattcggtatttcaattcagggatcagatcgccgaatccagctcgaggtatagttaggtacactgagtaggtgggaggcaccgattccgattaaatctgcagtctgggaatagaaaagatcctcattttctgtcaaaagatgcctgcccaaaatccacgaagctctaagctatcacagttcacagccttagtgcccttttcctttttttttgcacaatatttgtagaaaagaatttgggctaaaatactcagtaccttcattatgctagttgagagcaagcagatcactgccgtgacaagctggacaaaccaagatcattaaatgttggccaactactaacagtgtgatgaacatgtacacatctttgcacgcaatagcttcaatggaactgtggagcactgctcgaatgtatatatatgtgcctgaagggaactcagttc

SEQ ID NO: 52 - DNA, 3000 bp, Arabidopsis thaliana
ttctgtaataaatacgtattagaaaatgatgaagatattagatattctctcgaaatcaagtcgagggccattaaaattgatgattattagaaaaaaggttataaatacttagttggaagacctagctagctaataactaagaaaattaatagaagaaactctctcttattgatatgtcgtcgtccatgcttctatattggatatagttctcgcatatgagtaaatctactatcattaatacaaaaacaataatatcaaacgcttaattagcatttgaacaataaaaatcatttatgtattcatgcataatttagacacacacacacacgcacacgcacgaatatatacatgttgtagtacactagcacttaggtctaaattttgagaactacgcaatatgacaagtaactaaatctttgttaacctaactaatgcgttgttgttgacatagatgaggtacgaaatggttgtaatatgaattcttatacacattagtatatgtggaagccaagtagccaacgaaacacttgcatgtaaatttttttgattattctttacaagcttaaacgttttttatttaacctatagaggtaaaagaaaaacagtgattttggttttgacttatataaaccgaaactctttctatcactctatagagataaatatacaaagaaatgagtaagtttctctcactatagcattaatggagctttagatcatcataaatgcattgcaccctctctatgcgctcatcaataactccttttaaatttcttattgcaactccacctgttcttttccttcctctcttgtcctcttctccttcttcttcttcaacaacaaacttccattgttcttaatacctagctagctcttccccggtttgagattatcccaaaataacaccggttctcgggtaaccggtcggtttttccggagcaaccaacccttttacttctctttatcattgtctcagatcttctgttcttcaaaggcaaaaatgggcataaaccaaagatcattgtgaattagggtttcactgtgtctccaaaagtaagatctctattatcaaaaaagatctttctctctctacacatatatgtatgcatatgcatttgtgtgtatgtatcttaggttatgtttatagatcggatccatattgcatgttgttgagactcttagatcttctatttttttgtttatggtgttttttggttctcaagatctcgatgcctatgatttgtttttttttctagattattttagtttaatttaatttaatgttttttgtgtctttttgcggagacttatgatctaagataaataaagcgttaccaaaaactttcttggagttagcagtttcaaaaggggtttgacgaaatctacttggtggttgtgtcacaaaaaaaagaccattgacttattgtcaacgctttaattaaccctatatactatatactatttttaatcgcttttaattaatcaaccctatatatcctgtattaaactaattaaacttagcctttttcattagttttgttactggaaacggttcgtctttagtgcacaaagaccaaggtcaatttaattctttaataaattcaattgagagatcagaagcttgtgaatctggttctctctctctcttctcttactagcttttgagtcgacaaaagagagagaaaagatcattaaactcgaatccaaaacttcaaccaacaaaagggaaaaaaagaaaaaataactacaaagagatctatctttagggtttcaaaactttcttgagtttcagatcgaattgagtaagtatttatattatttaagtgttcttcttactgtatcatttctgaccatacaccaaactagggtttcttaaagatcataactctctctctctcgcttcttcctacactagatctgtccgatagatctgatgctttgagaagtcttgtgactttcaagattgatttttctttttgtttgtttgtttatatgtacacatacttggagatagatatactctcatatatgttactgtgcatatggatggatccatcttaagtgtgaataaaaactacccaaatctcatttttgtttgtttcttatctcatttgttgtttttgtaaggccgtcattataaatctaaaacaatttatccgttttcgtaaagaaaatcgctttccaaaaaaaaaaactttgaagtaaaaatatcattttgggtctatattcaaatctctcctcatatttccatctcattatttgtaaaattaatatattaggtcattatcatattgattatagagtttatatgttatgttataaagtaaaagttatatatgtaaatattacgtttgtaatatatatatttatacatatgtacgtatacataatttgtatgtatatgtgcctcatttttaacaaatattatcgttaatctttagtttcattataattttttagggatgtatacattatataaatattttatgttatttatatctgaaatttctatactataacatcttagatagttttcatacgtaattaagagttttaattaatagttacataattatgattagatgaatttatctataaattgtatgcaaaaatatatacatatccaaccgaaaaaatggagagtaaacaaaaacctaacaattaatggtttagtacttgtgaaaatgataaaattattaatttaatatatagtttcataacagctagaaataactttcccttaatataattattttcttccatttccataatgattttcttcttcttcattctgtatacatatatgagcgtttcatatataatcttttactaattcgattgtgattttgattttgggcagtggaagatatacttggagaagaaaatcaaatcacgaaaatatattgatcagtgccttgaaggaaaccaaagttgacaactccaaaaatccatttcgttattaatatctaactgagtgatcatagtcaatcatccataaca

SEQ ID NO: 53 - DNA, 6237 bp, Glycine max
taatattattatcagtggagtcacgtaggaaaatgaaagtagaaaaagtgtttgcggagaagaagaacataatgttgtgaaaaattaggattaataatttttttatttaattttttaataactaatgattttgattaatttataattaacttaataactcaattaattataagtatttattaataatctatcagaatgatcaaaatcactaatttataagatttgaggatcaaatgttataattaaaattcaggagacaacaatcataaatttgagaaactagatgactaaaaattacaattaaaatttaggaattaaaatcatggatttgaaaaattaggatgaccaaaattataatttaaccttcttttataagaagaaatttaaaagtctccttgcattaaatatttttttgaaaacattattaattatgaaccatttttctgaaattaggatgaccaataggtagaatattaatatttttttccttttcatatgtagagaatttacagaaatcttattgtgtactatctttacatctataaacaataaaaggtagagcaataaacatatttacagattaattaaacgacataaagacaacaaatatactaaacaaaaagaataaggacatgtttcattactattataggtaattttgaaaataatatataaatttagaataaatatataattattaatttaattaattatttttttaatctttatgaattagttgattgaattttataaaaagatcaaaagggagcggttaatttgtagatgacttgttattcatgagaaactaaagaaaaataagaattaatgatataaatattaatcattcaattcatcttgtatttactaaatcaatcaacaaattaatttaaatcagaaatctgatgttaattaaaatgacattattttctaaaatattgttaaatccttttactattaatgaattatataagaatcaaatttaaataaatataattattgtttagtgactaattttatcttataaaatgagtttaatatttatacactcatagtatacaagagttttacattatcatccaatcatgaattccgtttgaattactttaaaataattatttgaaaagtcaataaatttaatatatatgatgagtttaattaaatgaatatataaaactttttgcataatatcaatatataataattttctcttataaaaatagtatgtaagataattttctctcattatgattatatactaatacatttgttaaaaaaattataataacgatatactgtatcaaaattaaactcttataaaattgttacgaaataattaaatgttaaaatagagtctttctattgtaaatatatttaaatcaatatttaacaccaataaacaataaacattttgtttataaatattttaattatggctaatgttaaccctttttattgtgatccacaaaattatattgtcatgatttttttacgctctcgtattcttttttttttttgacttaattatttttttaacccctgaatttaagtcgtgtattttttttagtctttaaaattttttaaaaaaattctctgaattttgacaaatgatttttttttgacataataaattgatattttatgtcaatttttagtactttgtgaaatttttttagtatttcgtaatagtttcaaaatgaaaatttaaaataaactaatattatgatttaatttacagaatcaatccatttttttgtcaaactcatttcaacatcttgtaaaataagtataataattaatctttactatcaaaactagttttaagcccggcttaactaattattattttagtttctaaattttggatttgtgatttttttagtccttaaaattttaaatttatttctttgtttctgaattttgataaattattctttttagtcagagccatgtaaattgatattttgtgataatttttaactacttaaatttttaataaaaaaaccatcacaaagtgttaaaaaccaccatataatacagtgttagtttataagtaagagattaaaaaataaatttgtcaaaatttaaggattaaaaaaatatttttaaattttagagattaaaaaaatacactccaaattcaagaactaaagcaataattaagttttaattttttaaccaataacctaataacactcaccaattagcaagaccgtgaatacttgttaactttttaatttgaaaggcaagagtagaaggcagtgtaaggggctagggttgagaaatataagagtcacttcactggacctagctcacaaaataaaagttaaagcatggaacgatatcgcgctctaactctcttctattcatgtataaccatttaattaaatttacaccagtcatccctccataaatgcttctacaccctctgcaataacttcatgctgccaaaccctctcccacttgttctacttattcattttatctcttcctgcgtcgtttggttctatctctatttcgctttggcccacactaaactcacaacttccccatcaacaactccttcacttccctaattccccacacacattcttgtttctctgatgacccacaacacatccgtttcagtcaacaacataactaattaaggttcattccactctcaaacgcttaaggccccctcttgcatctacgcattcttaattttagctttgacttgctttgcttagcttagttaatttccgagtgagagaaaggggtaacggctacgttcccccgcattgaaattggttacttgacaagcgttatagtaatcatctgttttgtcaaacctttcacactgactcaacactctacccttattttgtcttttctgatttccctagcattgcaagttttgcgtgtaagataagagtagtaaggccaaggccagggaaagtcagcagtgtcctcttgcaaccttaacataagaatgaatctccagacaaacacttgaaagtgctcgaaatcgatcgatcagagacaaaacagcgacacgaggggcctggatgcttttattatcaatttttgctttgcgtggcggttccataaatcccaattgcaagtcccatcaaactttagagatggaaagcggttgattcattatattgcagtcgtcttcgtggttaatctatcaggtgatcacttccttaatttcttattttctctcataattaaacagaggtacaacaaattttcttttttgagtaaaacagcaagttgattaaatggaaaaactttaacattttattcattctcgatggggagaaaagtcattctggcttagaatttttttacatatatacagttgctattgttatcacatatgttcatcttaatgttttattgccaacaaagtttggtattttagcaatctacaagtatttctgaaaatgtttttttaggtgtgtcatggctttggttgaagctcaccttatttaaatttttttttttgaaaataatctacgtttcatctcgactaaaaataatcacacattaaaatatataagtgagagagacaattcttattccttaagttaatttttaggattaagttagacttctcacattctaagatcttattaatgtgagagacaactctcattctctcacttactttattgtaagaattttattctttctttatttttatgataagaaagtgttaatttttaatgtttattttagagagaaaaaaagtttctattgtgaggcccaggagaaaaataaattccttacctccccaaattggcatgaaatgggtgaggggaaaaatgatctcttactaatttttattttagttttcttaatatatatatctttaaaaatagttaaatataaaacaattttatttttaaagataagtatatttttctattagaatgaaaaatataactttttataaggtgtttggctatttggtgtttccataagcatcgagaataacttaaactctttatcctttttctaaatatgcaaattaaatcaaactcaaggatcatcctataccttttttagttagcatgttattggtataaaatatctacttgttttaccaataatcaattttcatccacaaatcttaaatctaagactttatttatttaaaggaattgagtcaaatataacttcgaccaacatcttggaaatatttatttatttatctaagtaattacaagaaaaaaattctctgcgtttttgttatttccatttatcaaaataacgcatctttgctactctattaatttttttttctttttttctttcttattttttctgtattttatttctaaatcaaatagaacattaatatgtttctatctaatcttttgttacccataataatcataaacttaaaaaaatttctgtgtaaactaaacttgtagttttaaaacaaaaaataaattccatttgtctactcaattaataaataattctaaattatttaatattctctcagtgtttatattttaacatctttaaatatcaaacactctattaacactcttaatttatctctatcattcttttagtatctcattgtctatcatatcgatgtttctctctcttttatttccatctctcaagatatcaattaaatttgggtgtttgaagactttttaccatattaattttcctactttctttttattttttcatcttgctcaatcattcgacttaactgacttgactactttctttttatatggtgagtatttaatgtgttttatattttaaaaacattaaatattttatatttatttttcatttaatacttttttcgtatggtaataatattcttttcatttaatactttttttgtacggtaacacttttttcaatttcaaccaatacaccttcacgtaaaaatattaaaaaaacaattaatttgataaataatttagaaaaagatattagttaaaaaatacatgtaatacttttaatcaataccgattatattttgtctttatactaattaatcaataccgattatatttcctctttaagtctttcactataaattgaattcgagtaatgttgtatgagaaatgcaaggaagacattttttaacaaactcttgatgatttccttaaaaaaaatacttcttttataattgattgaaatttataggaaatcataattttttggaatgctaggaacattctctttggcacactcctttaaagattctttgtatatacgattgactaaagtttattgaacaattttgataggttttaatttttatttaatataaatcaggagagagtatgaaaaataaaatgtaataaaaatgatgattttcattaaattctaaggaaatattaaaaaaaaaagcgttaaagaaagtgatgttaacatttatggtattcactaccaagcacattaattagtaatctttttaatttgagttgtgatagttgttttatccttgtaaaaaaaattctccaataaaaagtattagtatttattttttatataagattcaatttataattttttattttgattatttttaaattaaattgcctctaaataagttattatattggaaaaattaattgagatgagagaatttattatatgtcagaaatacaaatgtatttaatatttacttctacaaaaaataatttaaatacttaattgaatatgttttttaggtacatccttaattgaatatgtttaaaaatttctaagaaatttgagggtaatagttaataagatgcatagttttctttttattattactgatagttattaagtaaaaatatctatatttttcatatttttagatgctaaaagtattggattcttaatatttattattttaatacaatttaaaaatttatagaaagttaatattagaaaaatataattaatttaaaattaagaatagcattgctcatttactattttactaaaaatataaaatattatctgtcaagaaaatattaaatattaactatttaccttaggtagttatgaacattcaatgtattaaacttctaacgtatattatattgattattgaagttgttcaaaaaatattcttaagggcactcgctatagggctacacaaactagcctacttcttgctttcccacatttttgcttccgtcgggcgagttaaatgttttagaattcctggtttggcagagactagctagagaagaaaattgcggcttccgaattatttaagga

SEQ ID NO: 54 - DNA, 6192 bp, Glycine max
taatattattatcagtggagtcacgtaggaaaatgaaagtagaaaaagtgtttgcggagaagaagaacataatgttgtgaaaaattaggattaataatttttttatttaattttttaataactaatgattttgattaatttataattaacttaataactcaattaattataagtatttattaataatctatcagaatgatcaaaatcactaatttataagatttgaggatcaaatgttataattaaaattcaggagacaacaatcataaatttgagaaactagatgactaaaaattacaattaaaatttaggaattaaaatcatggatttgaaaaattaggatgaccaaaattataatttaaccttcttttataagaagaaatttaaaagtctccttgcattaaatatttttttgaaaacattattaattatgaaccatttttctgaaattaggatgaccaataggtagaatattaatatttttttccttttcatatgtagagaatttacagaaatcttattgtgtactatctttacatctataaacaataaaaggtagagcaataaacatatttacagattaattaaacgacataaagacaacaaatatactaaacaaaaagaataaggacatgtttcattactattataggtaattttgaaaataatatataaatttagaataaatatataattattaatttaattaattatttttttaatctttatgaattagttgattgaattttataaaaagatcaaaagggagcggttaatttgtagatgacttgttattcatgagaaactaaagaaaaataagaattaatgatataaatattaatcattcaattcatcttgtatttactaaatcaatcaacaaattaatttaaatcagaaatctgatgttaattaaaatgacattattttctaaaatattgttaaatccttttactattaatgaattatataagaatcaaatttaaataaatataattattgtttagtgactaattttatcttataaaatgagtttaatatttatacactcatagtatacaagagttttacattatcatccaatcatgaattccgtttgaattactttaaaataattatttgaaaagtcaataaatttaatatatatgatgagtttaattaaatgaatatataaaactttttgcataatatcaatatataataattttctcttataaaaatagtatgtaagataattttctctcattatgattatatactaatacatttgttaaaaaaattataataacgatatactgtatcaaaattaaactcttataaaattgttacgaaataattaaatgttaaaatagagtctttctattgtaaatatatttaaatcaatatttaacaccaataaacaataaacattttgtttataaatattttaattatggctaatgttaaccctttttattgtgatccacaaaattatattgtcatgatttttttacgctctcgtattcttttttttttttgacttaattatttttttaacccctgaatttaagtcgtgtattttttttagtctttaaaattttttaaaaaaattctctgaattttgacaaatgatttttttttgacataataaattgatattttatgtcaatttttagtactttgtgaaatttttttagtatttcgtaatagtttcaaaatgaaaatttaaaataaactaatattatgatttaatttacagaatcaatccatttttttgtcaaactcatttcaacatcttgtaaaataagtataataattaatctttactatcaaaactagttttaagcccggcttaactaattattattttagtttctaaattttggatttgtgatttttttagtccttaaaattttaaatttatttctttgtttctgaattttgataaattattctttttagtcagagccatgtaaattgatattttgtgataatttttaactacttaaatttttaataaaaaaaccatcacaaagtgttaaaaaccaccatataatacagtgttagtttataagtaagagattaaaaaataaatttgtcaaaatttaaggattaaaaaaatatttttaaattttagagattaaaaaaatacactccaaattcaagaactaaagcaataattaagttttaattttttaaccaataacctaataacactcaccaattagcaagaccgtgaatacttgttaactttttaatttgaaaggcaagagtagaaggcagtgtaaggggctagggttgagaaatataagagtcacttcactggacctagctcacaaaataaaagttaaagcatggaacgatatcgcgctctaactctcttctattcatgtataaccatttaattaaatttacaccagtcatccctccataaatgcttctacaccctctgcaataacttcatgctgccaaaccctctcccacttgttctacttattcattttatctcttcctgcgtcgtttggttctatctctatttcgctttggcccacactaaactcacaacttccccatcaacaactccttcacttccctaattccccacacacattcttgtttctctgatgacccacaacacatccgtttcagtcaacaacataactaattaaggttcattccactctcaaacgcttaaggccccctcttgcatctacgcattcttaattttagctttgacttgctttgcttagcttagttaatttccgagtgagagaaaggggtaacggctacgttcccccgcattgaaattggttacttgacaagcgttatagtaatcatctgttttgtcaaacctttcacactgactcaacactctacccttattttgtcttttctgatttccctagcattgcaagttttgcgtgtaagataagagtagtaaggccaaggccagggaaagtcagcagtgtcctcttgcaaccttaacataagaatgaatctccagacaaacacttgaaagtgctcgaaatcgatcgatcagagacaaaacagcgacacgaggggcctggatgcttttattatcaatttttgctttgcgtggcggttccataaatcccaattgcaagtcccatcaaactttagagatggaaagcggttgattcattatattgcagtcgtcttcgtggttaatctatcaggtgatcacttccttaatttcttattttctctcataattaaacagaggtacaacaaattttcttttttgagtaaaacagcaagttgattaaatggaaaaactttaacattttattcattctcgatggggagaaaagtcattctggcttagaatttttttacatatatacagttgctattgttatcacatatgttcatcttaatgttttattgccaacaaagtttggtattttagcaatctacaagtatttctgaaaatgtttttttaggtgtgtcatggctttggttgaagctcaccttatttaaatttttttttttgaaaataatctacgtttcatctcgactaaaaataatcacacattaaaatatataagtgagagagacaattcttattccttaagttaatttttaggattaagttagacttctcacattctaagatcttattaatgtgagagacaactctcattctctcacttactttattgtaagaattttattctttctttatttttatgataagaaagtgttaatttttaatgtttattttagagagaaaaaaagtttctattgtgaggcccaggagaaaaataaattccttacctccccaaattggcatgaaatgggtgaggggaaaaatgatctcttactaatttttattttagttttcttaatatatatatctttaaaaatagttaaatataaaacaattttatttttaaagataagtatatttttctattagaatgaaaaatataactttttataaggtgtttggctatttggtgtttccataagcatcgagaataacttaaactctttatcctttttctaaatatgcaaattaaatcaaactcaaggatcatcctataccttttttagttagcatgttattggtataaaatatctacttgttttaccaataatcaattttcatccacaaatcttaaatctaagactttatttatttaaaggaattgagtcaaatataacttcgaccaacatcttggaaatatttatttatttatctaagtaattacaagaaaaaaattctctgcgtttttgttatttccatttatcaaaataacgcatctttgctactctattaatttttttttctttttttctttcttattttttctgtattttatttctaaatcaaatagaacattaatatgtttctatctaatcttttgttacccataataatcataaacttaaaaaaatttctgtgtaaactaaacttgtagttttaaaacaaaaaataaattccatttgtctactcaattaataaataattctaaattatttaatattctctcagtgtttatattttaacatctttaaatatcaaacactctattaacactcttaatttatctctatcattcttttagtatctcattgtctatcatatcgatgtttctctctcttttatttccatctctcaagatatcaattaaatttgggtgtttgaagactttttaccatattaattttcctactttctttttattttttcatcttgctcaatcattcgacttaactgacttgactactttctttttatatggtgagtatttaatgtgttttatattttaaaaacattaaatattttatatttatttttcatttaatacttttttcgtatggtaataatattcttttcatttaatactttttttgtacggtaacacttttttcaatttcaaccaatacaccttcacgtaaaaatattaaaaaaacaattaatttgataaataatttagaaaaagatattagttaaaaaatacatgtaatacttttaatcaataccgattatattttgtctttatactaattaatcaataccgattatatttcctctttaagtctttcactataaattgaattcgagtaatgttgtatgagaaatgcaaggaagacattttttaacaaactcttgatgatttccttaaaaaaaatacttcttttataattgattgaaatttataggaaatcataattttttggaatgctaggaacattctctttggcacactcctttaaagattctttgtatatacgattgactaaagtttattgaacaattttgataggttttaatttttatttaatataaatcaggagagagtatgaaaaataaaatgtaataaaaatgatgattttcattaaattctaaggaaatattaaaaaaaaaagcgttaaagaaagtgatgttaacatttatggtattcactaccaagcacattaattagtaatctttttaatttgagttgtgatagttgttttatccttgtaaaaaaaattctccaataaaaagtattagtatttattttttatataagattcaatttataattttttattttgattatttttaaattaaattgcctctaaataagttattatattggaaaaattaattgagatgagagaatttattatatgtcagaaatacaaatgtatttaatatttacttctacaaaaaataatttaaatacttaattgaatatgttttttaggtacatccttaattgaatatgtttaaaaatttctaagaaatttgagggtaatagttaataagatgcatagttttctttttattattactgatagttattaagtaaaaatatctatatttttcatatttttagatgctaaaagtattggattcttaatatttattattttaatacaatttaaaaatttatagaaagttaatattagaaaaatataattaatttaaaattaagaatagcattgctcatttactattttactaaaaatataaaatattatctgtcaagaaaatattaaatattaactatttaccttaggtagttatgaacattcaatgtattaaacttctaacgtatattatattgattattgaagttgttcaaaaaatattcttaagggcactcgctatagggctacacaaactagcctacttcttgctttcccacatttttgcttccgtcgggcgagttaaatgttttagaattcctggtttggcag

SEQ ID NO: 55 - DNA, 1999 bp, Zea mays
tcggcctgtccattattgtaggaatagctagccgcccatgcaagttctattcagcctgccttttcatcgctctgaccaccatgtcctcatctgcgtgagatgtgctatcaatagttggacacaattcgtcctcaagctacgacggggacagtttgacattaccagagagagagagagagagagagagagatagagtgctagcaataggaggggatgcaaaaacatgtaccacctcaccgttctgtcgtacttccctctgatcaacttcacaacgttcaaatttaggcaaggcgctgtggctgaagtttacaatattctgcaccacctcactgtcttttgtagttccttctgatcagctttaagttgttccaattcaggcaaggcgctgtgggttaagttgacaattgttacctcagcttgatcaacagatgacactttttttttttggtgaagaagtgttggcttccgggtcacaagagtatcctctcctctgtactgtttctgaaacttgttgccttcctgtccattgtggcgattaggccggggttaaaaattcccagtttcgataacgattgctcgttgctgggttagactttgcacagaaatcttccgctcgaggagggggtttagttattaattacccacagtgatgagagtgacgtacgctgtactagaatttttgcgaatgactgacagtaatgacatcatcgtccctgacaataatatccaacatccaacgcccccacacttatattccagtccaggcatattgtatatgaacgagcgagcacgcacggtacgtacgtgtgcggtgtgtccgccggcgcctaccaggacgtagtacaacatcgccatctgagcccatgacgcccgcccagcgccagcgccagcggcacggcaaaagtcgccggcgccagcaagaacagcaggaagcacaggtttcaaagggggcgccgcgagccagggcccaggaccagcagcacgtacagagcgggagtaataaacgctgaaaagctccgcgccctctcgcgcaatcaatggcgacgcgacgcgaactctaccggccggctccgtccgccccagtcggggtccccacgcccccagggggagggtgcctctctcgctcactcacccgtcgccctgcgtgccgaattaatggcggcgaccgctgcgtgcaactgatccgacccgacccgaccagaccccccgcgccgacgaccgcctagctctgcactcaccgggaatcagagaccgaggcgccgcgagtagcagaggcaaccacccgttctttggagtcggagcgtcccggcccggtcgggatccattttctgcacgtcgtcaccactcaccacgcgcattggaaccgccggaagccgcgcgtgtgaaaaagctgctgcttcatggtcatggtcatggcggtcacacagcagcttaatttgttacgctaagtcgctaacagttgagacactggcacaagcagcatggccggcctccggctctcatgagactacttgcctcctgtgccagtgccagccagtatagaaattgagacgacgacgtcgacggcaacaacagccgtcaccaccacgccgcgtctcaatcccgttgggtttcaggcgccataactccagcagtcccgctgcgagtgagggggagccggtggcacggctgggctgcaacgatccgtgtccccccgcgtcctcctccttcctactgtgcggtgccggtgccgctgcccccaattgctcgcgttgcttgcgtcccttggcgaccaagttacatgtataaagccatgcatgaccagagaagaacacacaactgtcctggcctgtccacggtccacacacgccttccttatatcggcgctcacggttctataaaaaaaacacagtacgagcagagcaaggcggccgtgagctgagctgagggaaggacgacgtacggctcagttgctagcccggccgccggagctctccgagatctgggccgccagcaacac

SEQ ID NO: 56 - DNA, 3000 bp, Arabidopsis thaliana
attttaagaaattaaatctttttttttggtatctgtgtgttactttttataaatgtattttgaaaagtattatttcaatttatagataaatataattatgactctcaagtggatttttttttcacggtcaattggagtttggctgtgaatcttgtgaataatatcaactaattaagagtcggccgatactccgtatctttgatcactttcacccatatcttgaaatttaccaaatgttttctttcattggggtttctataccttttttttttggttctttctgtaatttgggttttaaagaaaaaacctataattacaaaaaaggttaaaagttaaaactaagcacgttcaaatatgttctttcgagatcccaccttcctgtctatcttataagaagtcgaacacgtgtgctcgttgtgtgaattagagtggttatttcaacatatataattaaactatgtatgtatcataaatacactgaatatgttggagttgggtcttgtggtaggctaacttgttcgcttcactttggtttagtttagccttgtaatcggtggtttcatatactgaaatttttaattttctaatataatccagatgacaaaaaaaaatcataaatacactgcaatggccatttttaaaaaaactttaaacgaaatatatatacatcaccaagtatcaagtaagtaatttggttgttttgatttttcaaaaaaacatttaggtgattcttttaacaaccaatcatatatgtagcaaagattaattatgtcaatcttttaacgtcacttatatagtttagctgtagtattattgtaagccaattgtacggacttcgtaaccgtttcgacaaagatacaaactaatcaatgtttaagatggcataatattccgacttcccctgccactcggtagtactgctgcgccatcctacaagaagcactcgtaaatgagtggttagacggccaaaaattagcaggattcaatccttgattaagagatggttcagataagccctctaggcctctactcgtcacaattcatatattaattgatcacactgcatgaaatgataagatcaagtcaattacctcaaaattaattgaaagataaaatgataaagcaacaagtaatgatcatatatggatgtaacaaccttcttcatccatacgaatatgataattcttttgtcgatcatttgccacatctatttaactaagtattttgtacattaagatcattttgcgagtattcccgcgttcccaacaaaaacgaattgaaaaactacatagggtgaattttgctctcgtggcattaaagagagaggctgacattatagattatgatatatttattatttttcttagtagatttcttgaccagcctttagatatgcttgctctgtcatggcataaagccttaaaccctaaagccctttacatttgtacagtaccaacaattgtacccaatgttaaatgaatgcggattaatttgtgatatgagaccatcaaaataaaatacttataagatagtagatatatagaaccgtaacaaaaagatgagaagaaaaagacaaattgaatagaaactggaccaaaagataaaagagtatatgaagaagcaagccaccaagaagtgtaaccatcgttgcttcaactgtaaaccgcacattaaatgtgtgtgagagaaagagagatagactccagctgtgagagctacgtccattgcatcaattgggttatatgtcgttaacaattttttaaaaatacataaataaatcaataaaatatttagaaaaaatcaatattataatgatattttgaagaagttaggtccataatggaaatatagagacttagtgtctatttatcaagaaatagtgtctatttatcaagaaataatgtctatttggtccacaattatcatattttttgtggccactcaaactacgaaaataatgaatattgttaatttttgtcttatttaagtctataactaacttactaattcggttgaaattgctaatatgcattttccttggtccactattacagtgctactgctgtcttattcttgaacacaaaataaaaaagatttcaaacacaaaatatgcatttttttgttccaccattacaaacctttatttggagaagtatacagttggatattaaatattttaattaaaaaattgaaaatattgaagttctttttctccagtattttggctggagcaaaactaaataaattccaaattaaaagctcgaacggaaaacatttactatgcaccaaaataaatgttgatatgaaatttgcatcagcatatacagtatgtatgtagtacaattgaacagagtcaaaattaattgtcactgaaacagtcagattttatttctgttaaaaaatattttcagacaaaaaatgattttttaacgtttttttatataattttattaaacctcaaaacattcctcagcagattgttttataatgttattattattttttcttaaataattttatttgaatttcgttatagagagataaataaaagatttttggggtctagttggctctcatagtttgaatgcttatataaggaaacagagctcgaggctctcaataatgccacataaaacacaacaccaaagcctttataactctttctggggtttttaattctctcaacgaacaaaaaaaaaaactcaactaatattctccatcctctttcttcagatttaagagaaaccttatcgttatattctctcttctcttttctttttgactcccacaagaagaaagcaaatttctttttctcaggattgcttgaaaactgtagaaatctttaaggtttttttacaccaataagagtcagagagagagagagagagagaaagagagatctattcataaaaaagacaggtaatctcaactccgaggagataactgatataacaatttgagagaataagaagaagaagaagaagaagaccaagctaaaga

SEQ ID NO: 57 - DNA, 2620 bp, Arabidopsis thaliana
attttaagaaattaaatctttttttttggtatctgtgtgttactttttataaatgtattttgaaaagtattatttcaatttatagataaatataattatgactctcaagtggatttttttttcacggtcaattggagtttggctgtgaatcttgtgaataatatcaactaattaagagtcggccgatactccgtatctttgatcactttcacccatatcttgaaatttaccaaatgttttctttcattggggtttctataccttttttttttggttctttctgtaatttgggttttaaagaaaaaacctataattacaaaaaaggttaaaagttaaaactaagcacgttcaaatatgttctttcgagatcccaccttcctgtctatcttataagaagtcgaacacgtgtgctcgttgtgtgaattagagtggttatttcaacatatataattaaactatgtatgtatcataaatacactgaatatgttggagttgggtcttgtggtaggctaacttgttcgcttcactttggtttagtttagccttgtaatcggtggtttcatatactgaaatttttaattttctaatataatccagatgacaaaaaaaaatcataaatacactgcaatggccatttttaaaaaaactttaaacgaaatatatatacatcaccaagtatcaagtaagtaatttggttgttttgatttttcaaaaaaacatttaggtgattcttttaacaaccaatcatatatgtagcaaagattaattatgtcaatcttttaacgtcacttatatagtttagctgtagtattattgtaagccaattgtacggacttcgtaaccgtttcgacaaagatacaaactaatcaatgtttaagatggcataatattccgacttcccctgccactcggtagtactgctgcgccatcctacaagaagcactcgtaaatgagtggttagacggccaaaaattagcaggattcaatccttgattaagagatggttcagataagccctctaggcctctactcgtcacaattcatatattaattgatcacactgcatgaaatgataagatcaagtcaattacctcaaaattaattgaaagataaaatgataaagcaacaagtaatgatcatatatggatgtaacaaccttcttcatccatacgaatatgataattcttttgtcgatcatttgccacatctatttaactaagtattttgtacattaagatcattttgcgagtattcccgcgttcccaacaaaaacgaattgaaaaactacatagggtgaattttgctctcgtggcattaaagagagaggctgacattatagattatgatatatttattatttttcttagtagatttcttgaccagcctttagatatgcttgctctgtcatggcataaagccttaaaccctaaagccctttacatttgtacagtaccaacaattgtacccaatgttaaatgaatgcggattaatttgtgatatgagaccatcaaaataaaatacttataagatagtagatatatagaaccgtaacaaaaagatgagaagaaaaagacaaattgaatagaaactggaccaaaagataaaagagtatatgaagaagcaagccaccaagaagtgtaaccatcgttgcttcaactgtaaaccgcacattaaatgtgtgtgagagaaagagagatagactccagctgtgagagctacgtccattgcatcaattgggttatatgtcgttaacaattttttaaaaatacataaataaatcaataaaatatttagaaaaaatcaatattataatgatattttgaagaagttaggtccataatggaaatatagagacttagtgtctatttatcaagaaatagtgtctatttatcaagaaataatgtctatttggtccacaattatcatattttttgtggccactcaaactacgaaaataatgaatattgttaatttttgtcttatttaagtctataactaacttactaattcggttgaaattgctaatatgcattttccttggtccactattacagtgctactgctgtcttattcttgaacacaaaataaaaaagatttcaaacacaaaatatgcatttttttgttccaccattacaaacctttatttggagaagtatacagttggatattaaatattttaattaaaaaattgaaaatattgaagttctttttctccagtattttggctggagcaaaactaaataaattccaaattaaaagctcgaacggaaaacatttactatgcaccaaaataaatgttgatatgaaatttgcatcagcatatacagtatgtatgtagtacaattgaacagagtcaaaattaattgtcactgaaacagtcagattttatttctgttaaaaaatattttcagacaaaaaatgattttttaacgtttttttatataattttattaaacctcaaaacattcctcagcagattgttttataatgttattattattttttcttaaataattttatttgaatttcgttatagagagataaataaaagatttttggggtctagttggctctcatagtttgaatgcttatataaggaaacagagctcgaggctctcaa

SEQ ID NO: 58 - DNA, 2792 bp, Glycine max
ttaaaaaaaatctcaaaagaataaattttcgactaccagtaattggattttaaataggaagagattaaaaaaccacctcttaatcttatattccatcttccattccataagattgtgggtgtcattaaaacttattatcaatacaaaatgaaaaataaagagtcacggtttgttgaggagaagaatgcacttagttccaaatcccaatacatgtattaagtagtttcgttaacttttttttattaaattttaattatgttcaattaattatcaatttctataattaatttattattttaccccgaatttgagggggaaaaagttaaacttataagatactttccatgttttttaaaaattgcattcaatatttttcttttttttttcaccctaaaaaaatattttaattagttaactcacattacactcagatccccttaacagaaggtccatgttgatcacattatttttaataaaaaattatgtctaaaataccctcaaataaattacacttgcacttccatgtgtttttttaaaattacatctaatattcctccttttttgtacactataaaaaatctcttaattatttagctcccattacattcactaagacttcttccctctcctaaacacagtttaataatttaatagaaagtagacacaatttgatcatatgacttttaatgaaaatttatatctaaaatattcttatcttcttcctcttaacttcataaaaaacataacattattttgaacctgaaaatattttaatacttttttttctctaattgaacctgaactcaccttgttggtacgtatgtgttaatatctttccttttttttttttacttcaattttttttgtgtgttgagttgtttggttgcaacatttttgttggacatgttcccaacaatgccaattgattgaatatgatcatttgcttcaaattttaatgttttgttcatgcatttgtgttttaactcctttctttgaaatatttatttttgatgactagttgcttgatataatgtctcaatcaagagtttatatcttcttcgagtaatagcaacaacgaagtaaaaataaaatattaaaggaaaattgttattgtcttaagaaaaattcattaacagagtcaattgttaatttgttattgagtatttaacaaagatgttaggacaatttcatctgctcatatattccaattgatgttaattaacgacgttaacggaaagagataaaaataatgtaaaaaaaggaaggtatatcagatgcaatttgagaaaaacacaagaaatacgattataacaaaaatgttaaaacaattttatctgttcacatatttcaattaacgtaacaacgttaataaaaaagggataaaagtaatataaaaaagagaagtatcaagtgtaatttgaaaaataaaaaaacacaagaaatacgagtagtgtaattttttttagattaaattaaataataaagtctttgttaaattaaacataaggttactttataatgctctcataatgaaaaccggatttagaggtaactccaaacctaccttatctaacagctgagaggtactgtttcacctgccaaccatataaggcatttactactactctccagatctcttactgctggattacaacacgctacagcaacacgacgcgcggggtgtgtgttttcgtttacgtagattttaattttttaaggctctaattataattaattacagcgtaattaatatggagtactataaagtataataattataataagccatgtatataaaaaggagaagtgtatctgttaatgtgtactaatatcttacacaaaagtatctgataggagtgctcgtgaaatgaaataaaatgatgttattaccagaataacaaatatagaatttagctaacatatatagttaggttaaaatgtttttatataaatatttaatagaaaattacattctccttacattatagttagcattaacgattaagatgatataataaaatgatcaaatcttattaaatatctgtctaaaaataacttaaactaatataatcggtatataaacttaactcttaaatacaacagtgattaaaataaaatcaactttatcaattattatatttaaaaaattaaatagaaataattttatgaaaaaaattactataaaatgcattgataatattgaatactaataatttttaatagtttgtttttagaccaccaaaccagaatcaatcaagggagggttatttcagcttaactaagtttttatatattattttatttatttcataagattaaaatctcaagtgagatacatgaatcaaatagtagtacttttttttagaatatattaattgataatttaatgtcccagttagcagaagacaggtgggagactatcttactttgtaggccacaaggatcaatgcatgatccgcagcgcttataaatacgtgatgggacgaaagaatatatttttaagttgtggctcaaaagcaattactactaagaaaggataaaggaaggaaggaacacttttctgatattctttttggtattgggttgctgacctttgctagtgttatagattttttgggttctcttgtgttttaataaatacaggaaaaaaaaagtatataggtgcctagaagaaaagacaatatagggtgtggagcaattacgtttgatcacaagggaaaaggtgcaacggtttgcaagatagcatagaagattttgaagaatcttaattgcaacatagtagtgcagttgca

SEQ ID NO: 59 - DNA, 2500 bp, Glycine max
ttaaaaaaaatctcaaaagaataaattttcgactaccagtaattggattttaaataggaagagattaaaaaaccacctcttaatcttatattccatcttccattccataagattgtgggtgtcattaaaacttattatcaatacaaaatgaaaaataaagagtcacggtttgttgaggagaagaatgcacttagttccaaatcccaatacatgtattaagtagtttcgttaacttttttttattaaattttaattatgttcaattaattatcaatttctataattaatttattattttaccccgaatttgagggggaaaaagttaaacttataagatactttccatgttttttaaaaattgcattcaatatttttcttttttttttcaccctaaaaaaatattttaattagttaactcacattacactcagatccccttaacagaaggtccatgttgatcacattatttttaataaaaaattatgtctaaaataccctcaaataaattacacttgcacttccatgtgtttttttaaaattacatctaatattcctccttttttgtacactataaaaaatctcttaattatttagctcccattacattcactaagacttcttccctctcctaaacacagtttaataatttaatagaaagtagacacaatttgatcatatgacttttaatgaaaatttatatctaaaatattcttatcttcttcctcttaacttcataaaaaacataacattattttgaacctgaaaatattttaatacttttttttctctaattgaacctgaactcaccttgttggtacgtatgtgttaatatctttccttttttttttttacttcaattttttttgtgtgttgagttgtttggttgcaacatttttgttggacatgttcccaacaatgccaattgattgaatatgatcatttgcttcaaattttaatgttttgttcatgcatttgtgttttaactcctttctttgaaatatttatttttgatgactagttgcttgatataatgtctcaatcaagagtttatatcttcttcgagtaatagcaacaacgaagtaaaaataaaatattaaaggaaaattgttattgtcttaagaaaaattcattaacagagtcaattgttaatttgttattgagtatttaacaaagatgttaggacaatttcatctgctcatatattccaattgatgttaattaacgacgttaacggaaagagataaaaataatgtaaaaaaaggaaggtatatcagatgcaatttgagaaaaacacaagaaatacgattataacaaaaatgttaaaacaattttatctgttcacatatttcaattaacgtaacaacgttaataaaaaagggataaaagtaatataaaaaagagaagtatcaagtgtaatttgaaaaataaaaaaacacaagaaatacgagtagtgtaattttttttagattaaattaaataataaagtctttgttaaattaaacataaggttactttataatgctctcataatgaaaaccggatttagaggtaactccaaacctaccttatctaacagctgagaggtactgtttcacctgccaaccatataaggcatttactactactctccagatctcttactgctggattacaacacgctacagcaacacgacgcgcggggtgtgtgttttcgtttacgtagattttaattttttaaggctctaattataattaattacagcgtaattaatatggagtactataaagtataataattataataagccatgtatataaaaaggagaagtgtatctgttaatgtgtactaatatcttacacaaaagtatctgataggagtgctcgtgaaatgaaataaaatgatgttattaccagaataacaaatatagaatttagctaacatatatagttaggttaaaatgtttttatataaatatttaatagaaaattacattctccttacattatagttagcattaacgattaagatgatataataaaatgatcaaatcttattaaatatctgtctaaaaataacttaaactaatataatcggtatataaacttaactcttaaatacaacagtgattaaaataaaatcaactttatcaattattatatttaaaaaattaaatagaaataattttatgaaaaaaattactataaaatgcattgataatattgaatactaataatttttaatagtttgtttttagaccaccaaaccagaatcaatcaagggagggttatttcagcttaactaagtttttatatattattttatttatttcataagattaaaatctcaagtgagatacatgaatcaaatagtagtacttttttttagaatatattaattgataatttaatgtcccagttagcagaagacaggtgggagactatcttactttgtaggccacaaggatcaatgcatgatccgcagcgcttataaatacgtgatgggacgaaagaatatattttt

SEQ ID NO: 60 - DNA, 2691 bp, Oryza sativa
tgccggttcggcggaagaaacaccgaccaaattttattaagattgaaagaagttacatgcatccgacattagaccgtcgagttaaggcgagaagacctaagaagcaaaacaaaagaaaaactgagagaagaatgtaaagggcaagtgcacttagggctactcctcactaaaccttcttttgtggattgatgcatcaaaaaactatatgtactaggttacatcgtgttttttttttcgttttcgtctcattctctgcttcggcctgccgtctgcttataccgttaattcgatgatgactccagacttcattcatgaatatatttctactatagatatacaaccctcgctcctctatgtttatcttcatcttcatcttcaggagattcaaacaccacctcttaaagatgaagatgaagatgaagataaaaattaagtgtttcacgtaaaacgatgtattaataacatgtgattaatagagttttaattgttataaacttgaaaaatgaattagtatgatattttagagcaactttcatatataaagttttcgcacgagacgtaccgtttagcagtttgaaaagcatgtcacgagtatccaaaatttaatcttgtgcttgcagaagaaacgaagagggcctaacccatataacctgcgtcattaatctatagcttagcaaagtttacttttttgcctgcctcctggcacaggaacgccgacgaagaaaaacctacaggctttctcaactatgattccttcctcaacctgtgaactctggcgacaggaggacgacaggggtgtatgtggagcagataatgcacagtaataatccaatccttaggacttacaaactgctggaatgaactgaccaagtacgtttagaacgtaggaattttgacttatacatgcatagtgtgatttgtacgtgaaatacattaattaattttctgaatttgtttccaatttctcgtcgtcaggcaatgccgcaatgccttgtcttaaagattgcaaattgaatgcgccatctccatcgatctctctatctccattgatggctgcccaaaaaataaaaaataaaaagagccgacaatgtttaaggagagaagcatacgcgcacgtttcgtgatgaaacatacatgcaagactaatttcgaattatatatcacatattcgctctctgaatgagcgtatcgggtatttggaatttcgtttgatatgtaaaagttgaattttaggttacttttttgtggaataatatatcataaattaatattttttataactatttatgtgacatgtaaatgacgagctgatatcagtttaggataatttcctcgctaggtgattgaacgaaccctgcacgcggcagacgtcgtggctactactatctagctagctagcgttggttacgcgtggctactatccagccagaattggttacgccgtcgcccatcgatccgccacaccacgccaaacgcgaacttaattgctactatccgatagtatgtacgcgtactacacaaaagtggggaaaagaaggttgtcctgactccatgagaagacgatccaaaacacggggccggacaaccaaacaagctagctagcggccggcggcgagccaccgtcgtcgttgctgaagacgtcgactaatttggcctcccggccggcgccatcgatcatctcaaaattaatactccctctgtataagggattttgagtttttgtttgcactgtttgatcactcgttttattaaaaaaatttgtgacaatataaaaaacgagaagttgtgcttaaaatacttcggataataaagtaagtaaaaaataaataataattctaaaaaaaatttaataaaataagtgtgcaaacaatacaagcaaaaactcaaaatcacttataatcatgggacggagggagtatatagtatccaaaaatcatctcaaaattaaaaccgaatcgaaactcgccgggccgcggcccgcccggccgtcctggcccaattaattccggcgaccgctgcatgcaacgctccgtacgtgatcgcccagcggctcgcgcgcgcaccacgcgtccacgcgtctctctcctttatacatggacaatggattaatttacttgtagaaaaaaaaacacgaggctagcttagcttgtgcccggcccagccgcgtgcgtgatttccccaagttcacaacctgtacgtgtgtgtggtacgtagcggtcgcaatcccgtttcaaatctcgatcgtgtgtggtgccattaactccgtctggttggggaagccggtggcggatagcccgactgacaggtgctgtggcctggcggccggccggccaatcgatggatggacggatggatcccatcgatgatccttcgttgattcgcgtcaacctctcgctgcccgaatcggactctcaccttccccgccctccaccgctgtgaccgcgcgctgtctgtcccttggctaataccagtcgcagtgcaactgtgcaagtgtttcacgtatataaaagcatcccgagacgcagcgcgcatgaccagccgcgttgggtgcaaaaccacaaccgccaacatcttctaactcccctcacggctctccctctccccgcacgcacaacaccggtgaacccctacgtactactgagctgagctgagaggacgaagaagaagatcaagctcgaggggcttgcgatc

SEQ ID NO: 61 - DNA, 2500 bp, Oryza sativa
tgccggttcggcggaagaaacaccgaccaaattttattaagattgaaagaagttacatgcatccgacattagaccgtcgagttaaggcgagaagacctaagaagcaaaacaaaagaaaaactgagagaagaatgtaaagggcaagtgcacttagggctactcctcactaaaccttcttttgtggattgatgcatcaaaaaactatatgtactaggttacatcgtgttttttttttcgttttcgtctcattctctgcttcggcctgccgtctgcttataccgttaattcgatgatgactccagacttcattcatgaatatatttctactatagatatacaaccctcgctcctctatgtttatcttcatcttcatcttcaggagattcaaacaccacctcttaaagatgaagatgaagatgaagataaaaattaagtgtttcacgtaaaacgatgtattaataacatgtgattaatagagttttaattgttataaacttgaaaaatgaattagtatgatattttagagcaactttcatatataaagttttcgcacgagacgtaccgtttagcagtttgaaaagcatgtcacgagtatccaaaatttaatcttgtgcttgcagaagaaacgaagagggcctaacccatataacctgcgtcattaatctatagcttagcaaagtttacttttttgcctgcctcctggcacaggaacgccgacgaagaaaaacctacaggctttctcaactatgattccttcctcaacctgtgaactctggcgacaggaggacgacaggggtgtatgtggagcagataatgcacagtaataatccaatccttaggacttacaaactgctggaatgaactgaccaagtacgtttagaacgtaggaattttgacttatacatgcatagtgtgatttgtacgtgaaatacattaattaattttctgaatttgtttccaatttctcgtcgtcaggcaatgccgcaatgccttgtcttaaagattgcaaattgaatgcgccatctccatcgatctctctatctccattgatggctgcccaaaaaataaaaaataaaaagagccgacaatgtttaaggagagaagcatacgcgcacgtttcgtgatgaaacatacatgcaagactaatttcgaattatatatcacatattcgctctctgaatgagcgtatcgggtatttggaatttcgtttgatatgtaaaagttgaattttaggttacttttttgtggaataatatatcataaattaatattttttataactatttatgtgacatgtaaatgacgagctgatatcagtttaggataatttcctcgctaggtgattgaacgaaccctgcacgcggcagacgtcgtggctactactatctagctagctagcgttggttacgcgtggctactatccagccagaattggttacgccgtcgcccatcgatccgccacaccacgccaaacgcgaacttaattgctactatccgatagtatgtacgcgtactacacaaaagtggggaaaagaaggttgtcctgactccatgagaagacgatccaaaacacggggccggacaaccaaacaagctagctagcggccggcggcgagccaccgtcgtcgttgctgaagacgtcgactaatttggcctcccggccggcgccatcgatcatctcaaaattaatactccctctgtataagggattttgagtttttgtttgcactgtttgatcactcgttttattaaaaaaatttgtgacaatataaaaaacgagaagttgtgcttaaaatacttcggataataaagtaagtaaaaaataaataataattctaaaaaaaatttaataaaataagtgtgcaaacaatacaagcaaaaactcaaaatcacttataatcatgggacggagggagtatatagtatccaaaaatcatctcaaaattaaaaccgaatcgaaactcgccgggccgcggcccgcccggccgtcctggcccaattaattccggcgaccgctgcatgcaacgctccgtacgtgatcgcccagcggctcgcgcgcgcaccacgcgtccacgcgtctctctcctttatacatggacaatggattaatttacttgtagaaaaaaaaacacgaggctagcttagcttgtgcccggcccagccgcgtgcgtgatttccccaagttcacaacctgtacgtgtgtgtggtacgtagcggtcgcaatcccgtttcaaatctcgatcgtgtgtggtgccattaactccgtctggttggggaagccggtggcggatagcccgactgacaggtgctgtggcctggcggccggccggccaatcgatggatggacggatggatcccatcgatgatccttcgttgattcgcgtcaacctctcgctgcccgaatcggactctcaccttccccgccctccaccgctgtgaccgcgcgctgtctgtcccttggctaataccagtcgcagtgcaactgtgcaagtgtttcacg

SEQ ID NO: 62 - DNA, 2946 bp, Populus trichocarpa
tactgtgaaaaaataacttgtccagtttttatttcatctgcatttttcaataccaacaaaatcatcgtgaaaatatttgatctaaaaaatcattttttaccatctatttcctattagaaattccaacaccatttatttttatgatagaaaattttatttatttatttgataaaaaataatgaaagaaaatgacgaggaacttaataaaaaaatataataaaacaagaaaaaggataagatttttttaaaagaatgacaactaagattggataaaaaaataaaataaaatactgagggacaaaattgaaagaaaaaacaaattaagaaaaggataaaaaagagcaattccaaaaataaggactaaatctggaaaaaaagaaatgaaataaaatatcgagggacaaaattgaaagaaaaacaaaccaagaaaattataaaaaaaaacaacaatcaagagaatgagtaccatgtttgatataataacaaaacaaaatcaatgaaaatggatgaaaatgaagaaaaaatccaaaacaaagaaagagcaattaaaagaaagaggatcataattgaatttttttcaccattattttttttatcaaaataatataaattttactttttagttgaataaaaaatcaagttattagttaggggaaaatcatgttaacacccattgatttttatttttgccattatttttttttatcaaaataatgtcattttacttcctgcaaaataaaaaactcgattgaccctggtaaccctgatcactcgacccaacccatgactcgggagatgatgggggtcgactcctaagccgggttttaaaagcatgataaaaaaataagcactaaatatgaaatgaaaatccaataaaattaaacaatgactgatgaaattgcgaaaaaaaattaatcaataagagaactaaaaataacaggaattacaatcataagaataatgaacgaattcaacaaaaaaaagaattaaaatcaaatgataatggattaaattgaaaaataaattccaattagaaaaaaaaagattaaaagcaaaataaataggaataaaaaaatgaggatcaaatttgacaaaaaacataaaaaaatcaaatgttaagggatgaaattaaaaaataaataaatcagattcgatacaattagaaaattgagaaccattttgcaactttacaaggttaacacatcttttgatatagaggagagagaaaagaggggtggagaaaattttttgcttgaactccgctgcgccacgaatgatgacatgtgttggcccaccgtgtggagggcgacatgacacttcggatgccgttgttaaagaccactaacaaccactgggaggagcctcacgcgccactcaaaaggcgcgagcgccttccacttgctggcgagtgctctgcgcgccccaactacttttttttttgaattacagaaagatcataacattcatgaccccacatgataatttaaaaaaaatctaaaaacaccccttgaccttaaacaagaaaaagttaattccaagggttattacagagagcaaaacactcctaatcccatgtgataattgcaaaaataaacctaggtttgagaaaccaaagataccctttacccttagaaaatatttttgaccccaagagctatttggtaattagactatgaaaaaatatgaaaattaagaaatgaccattgaacataaaacctttttttttccttctaaaatcatgggcgtaattatactaagcaacaaaatgtaaaaatactattccactcttatatgtattttatattttgatatctttgaaggacaaattaatcgttttattatgaattgcactgtggacaatccacaataaaatactgataccttttagttatatgttaaacattgaagaaatgttttttcatatttttcacgatttttttatttttatatcttttagttttccaaatttaatagtaaaaattaaattgggtaaaattattagtctaaatatgatgtaaacataaacattaaaatgataaaatatttaaagagatatttatataaaaaaattaatttattgccatccctatcttttatcttctttaaccttccttgctagaaagaataaaaaaaaatagttaaaaaatattcttaaaatcaagacaaaaattaattattatttccatctccaccataaaatatatttcttattggtttatttgatattataatagcggttgtttttttataaatatattaattattttttaaaatttatttttaacattaacacatcaaaataattttaaaaaattaaaaaattaattttaaataaaaaaaccctataatagaacgtaaaaaaaacaaacacgtattttgaattaattaccaatttggcacaaaccgtgagctgaattcttcaactgcccaaccaaagagtcattaatttctaggagcatgaggccaccactccagctgtgtgccaaatgacaagggaggagaggaaatgagacaaaaacatggaagtgtgagctgctaaataaagattgattaagaacttcaactgtatttttggtccttccttcaagctatatatatgtgggtgcctccataaagatatcgcagttacgagtaatagatatacagtgttagtcgagtctttaaaggaaaaaatcaaagagagagagactgaacttgatactctcttcctttcatctctctctccccctcttaccctctaagggttgctccatctggagcttgcgttcatgttttttcgcttcatttgtggtgtagctaaccactttgagccataaccagggaactatctttttacccaacaagataaagctgcttacaggagcaaaattgagacatatactccagtaaaaactcaagaaaaaattgaagaaaaccgttgaagatcaggtgctttactgcaaaaaa

SEQ ID NO: 63 - DNA, 2500 bp, Populus trichocarpa
tactgtgaaaaaataacttgtccagtttttatttcatctgcatttttcaataccaacaaaatcatcgtgaaaatatttgatctaaaaaatcattttttaccatctatttcctattagaaattccaacaccatttatttttatgatagaaaattttatttatttatttgataaaaaataatgaaagaaaatgacgaggaacttaataaaaaaatataataaaacaagaaaaaggataagatttttttaaaagaatgacaactaagattggataaaaaaataaaataaaatactgagggacaaaattgaaagaaaaaacaaattaagaaaaggataaaaaagagcaattccaaaaataaggactaaatctggaaaaaaagaaatgaaataaaatatcgagggacaaaattgaaagaaaaacaaaccaagaaaattataaaaaaaaacaacaatcaagagaatgagtaccatgtttgatataataacaaaacaaaatcaatgaaaatggatgaaaatgaagaaaaaatccaaaacaaagaaagagcaattaaaagaaagaggatcataattgaatttttttcaccattattttttttatcaaaataatataaattttactttttagttgaataaaaaatcaagttattagttaggggaaaatcatgttaacacccattgatttttatttttgccattatttttttttatcaaaataatgtcattttacttcctgcaaaataaaaaactcgattgaccctggtaaccctgatcactcgacccaacccatgactcgggagatgatgggggtcgactcctaagccgggttttaaaagcatgataaaaaaataagcactaaatatgaaatgaaaatccaataaaattaaacaatgactgatgaaattgcgaaaaaaaattaatcaataagagaactaaaaataacaggaattacaatcataagaataatgaacgaattcaacaaaaaaaagaattaaaatcaaatgataatggattaaattgaaaaataaattccaattagaaaaaaaaagattaaaagcaaaataaataggaataaaaaaatgaggatcaaatttgacaaaaaacataaaaaaatcaaatgttaagggatgaaattaaaaaataaataaatcagattcgatacaattagaaaattgagaaccattttgcaactttacaaggttaacacatcttttgatatagaggagagagaaaagaggggtggagaaaattttttgcttgaactccgctgcgccacgaatgatgacatgtgttggcccaccgtgtggagggcgacatgacacttcggatgccgttgttaaagaccactaacaaccactgggaggagcctcacgcgccactcaaaaggcgcgagcgccttccacttgctggcgagtgctctgcgcgccccaactacttttttttttgaattacagaaagatcataacattcatgaccccacatgataatttaaaaaaaatctaaaaacaccccttgaccttaaacaagaaaaagttaattccaagggttattacagagagcaaaacactcctaatcccatgtgataattgcaaaaataaacctaggtttgagaaaccaaagataccctttacccttagaaaatatttttgaccccaagagctatttggtaattagactatgaaaaaatatgaaaattaagaaatgaccattgaacataaaacctttttttttccttctaaaatcatgggcgtaattatactaagcaacaaaatgtaaaaatactattccactcttatatgtattttatattttgatatctttgaaggacaaattaatcgttttattatgaattgcactgtggacaatccacaataaaatactgataccttttagttatatgttaaacattgaagaaatgttttttcatatttttcacgatttttttatttttatatcttttagttttccaaatttaatagtaaaaattaaattgggtaaaattattagtctaaatatgatgtaaacataaacattaaaatgataaaatatttaaagagatatttatataaaaaaattaatttattgccatccctatcttttatcttctttaaccttccttgctagaaagaataaaaaaaaatagttaaaaaatattcttaaaatcaagacaaaaattaattattatttccatctccaccataaaatatatttcttattggtttatttgatattataatagcggttgtttttttataaatatattaattattttttaaaatttatttttaacattaacacatcaaaataattttaaaaaattaaaaaattaattttaaataaaaaaaccctataatagaacgtaaaaaaaacaaacacgtattttgaattaattaccaatttggcacaaaccgtgagctgaattcttcaactgcccaaccaaagagtcattaatttctaggagcatgaggccaccactccagctgtgtgccaaatgacaagggagga

SEQ ID NO: 64 - DNA, 2817 bp, Vitus vinifera
tatattatgtaagtttgaaaaaaaggataatatttgataaggtatttaaaaattatttacttcaaaaatgcattcaacaataataatttttaaccatttatctttcatgttcaatttattggagaaaaattattggtaaatcattcaacttggtcccattaataaataggtactaataaataggtgagagaatggtgaaaaaaccaaagagagaataagaaaggtagagtgaccagagttttttcatttaatagtcagaggtattttaggaattttttgaagacaatatctttcatttcaatttctactctttcattgggttttaagtttaattataaattatatgaggaccttatctcaattattcaacccaactgggatagaaacagaattctccctatttagattagggaaaattgatttaaggttttttttttttaaatagagttaacaataaaatacaaactaacaaactttcaagagaaagaaaaaaaaaacacttataatattacaaaaaaaaaaaaaaaaaaacacatcctaatcacatagcaaaactcaatattttttctctctcttcttttgtcctattaacaaccaaacatgattcaattaattgaattaaactattaaactaataaaaagagccgatccaacttggttgttagttgttccgtattgcatttgcttttacggatgaggaaattgaattaaaattgtaattagcataacagacgaagaactgaatatagtcagggagtagaggaaaagtttagattatatttatgacattaaaaatcaacctaatccaacttggttgttagttgttccgtactgcagttgatttttatgcataagaaatattggacggtccaatataatataatattagttgatatatagctttcagttaggttggaaggtggacaattgcaagtgccaagtcaaggttagtggcaagggcggctccatcattcacaatttgcctgccattacctcccttttgcttggagttttcccatcaagcaatacatttattgttgtttatagtgttaaagggattatgcaaatatcatttcatataagctgaaggaaatttcatgaaaaaaaaaatagcatttattatttatactatgaaggcaaccatagaaattaatatcatttcataaagttaaacaaatttaaggcaaaaaggaatttgttgcctatcacattaaagaaaatgatagaattaagggaagaaaatttagtctatgtttagtttttgaaaaatttgaaaaaaaaatggaaagaaagaaaataaaaataaaaaataaattatttttatatgttttcttaaatttcataaacttatttttcttcattgtattaagattaaataattttaaaatatataaatttttaattaattttaattatattttattttcttttatatttttcatgatgaaatcaaacatgaaaaaataattttttttaatatttttttttctttccttattatttttcaagaaccttaaaaatgtaaaagttttaagttttaagttgatttctttttcttttttttagtcttttttatttttaggaaatataaataattttaaaaatctgtaaggatttttttttcatttgataatataatcatatttttataaataatgaacatatactttgagactttgaattaatgtaaatttaaataattatcctcctaaataatatttataaaaattgaatgtagttctcaagaaaagaaagaattaaaataaattgttcaatttttactttttttatttacttaaaatccaactattttccaaaattttgagggagtgagtacatagaatgattcatttttcttctactcataattcattttggagattcaaatgaatgaaaattagatagtatagtctattttcaaattcacaagttgaagaaaaaaaagtgatgatgagtagaaagatgtatcgtcaagttcatcatttaataggcacaccgccacaaatcctcattcatcttgaagaatgaacttagagatgagattttggaagtgtacagtgtgatacgtatgagtggtgtgtattggtacattaagatggataaagatggaaataaaatggagagaaagaaagagagagaggaggaaaaatagaacatgctgctgaatagtatagggtaaccggccccatgacttagcaatacgcaattactgaaaagctccaaccctcctcccaaccatgagccattaatgtcttaagagaatcaggccatcactacagctgtgccatcctccctagcaaatgcccctacgcgttctcaatttggaggacactttttggtcaatttcggtgacgttcatactttgcctagagacaaaatattgatcaatattacaagctaaccgatagagactgattaagagctttaactgtatttggatgcccacttagtttttggagctataagtaggtgcattggagttgggaaaaataaaggccagagtttgggagacttgcaaccaagtttcacaaatacaggggcttaatcaagttgtttcattatccaattattttattataaggcaattccaacctcttaacctctcgatctctttccttctttctgctgcttctatctgggaattgtttccttccctttcctctctttctttttcttgtatttggcttcttctactattttgggctacaatatctcggatctttctgttcccgaactgaaacttttcctcatcaaaagcctgtacagatagagaagagtttgcacatatattaagaaaggaataattttgtcggaaaa

SEQ ID NO: 65 - DNA, 2500 bp, Vitus vinifera
tatattatgtaagtttgaaaaaaaggataatatttgataaggtatttaaaaattatttacttcaaaaatgcattcaacaataataatttttaaccatttatctttcatgttcaatttattggagaaaaattattggtaaatcattcaacttggtcccattaataaataggtactaataaataggtgagagaatggtgaaaaaaccaaagagagaataagaaaggtagagtgaccagagttttttcatttaatagtcagaggtattttaggaattttttgaagacaatatctttcatttcaatttctactctttcattgggttttaagtttaattataaattatatgaggaccttatctcaattattcaacccaactgggatagaaacagaattctccctatttagattagggaaaattgatttaaggttttttttttttaaatagagttaacaataaaatacaaactaacaaactttcaagagaaagaaaaaaaaaacacttataatattacaaaaaaaaaaaaaaaaaaacacatcctaatcacatagcaaaactcaatattttttctctctcttcttttgtcctattaacaaccaaacatgattcaattaattgaattaaactattaaactaataaaaagagccgatccaacttggttgttagttgttccgtattgcatttgcttttacggatgaggaaattgaattaaaattgtaattagcataacagacgaagaactgaatatagtcagggagtagaggaaaagtttagattatatttatgacattaaaaatcaacctaatccaacttggttgttagttgttccgtactgcagttgatttttatgcataagaaatattggacggtccaatataatataatattagttgatatatagctttcagttaggttggaaggtggacaattgcaagtgccaagtcaaggttagtggcaagggcggctccatcattcacaatttgcctgccattacctcccttttgcttggagttttcccatcaagcaatacatttattgttgtttatagtgttaaagggattatgcaaatatcatttcatataagctgaaggaaatttcatgaaaaaaaaaatagcatttattatttatactatgaaggcaaccatagaaattaatatcatttcataaagttaaacaaatttaaggcaaaaaggaatttgttgcctatcacattaaagaaaatgatagaattaagggaagaaaatttagtctatgtttagtttttgaaaaatttgaaaaaaaaatggaaagaaagaaaataaaaataaaaaataaattatttttatatgttttcttaaatttcataaacttatttttcttcattgtattaagattaaataattttaaaatatataaatttttaattaattttaattatattttattttcttttatatttttcatgatgaaatcaaacatgaaaaaataattttttttaatatttttttttctttccttattatttttcaagaaccttaaaaatgtaaaagttttaagttttaagttgatttctttttcttttttttagtcttttttatttttaggaaatataaataattttaaaaatctgtaaggatttttttttcatttgataatataatcatatttttataaataatgaacatatactttgagactttgaattaatgtaaatttaaataattatcctcctaaataatatttataaaaattgaatgtagttctcaagaaaagaaagaattaaaataaattgttcaatttttactttttttatttacttaaaatccaactattttccaaaattttgagggagtgagtacatagaatgattcatttttcttctactcataattcattttggagattcaaatgaatgaaaattagatagtatagtctattttcaaattcacaagttgaagaaaaaaaagtgatgatgagtagaaagatgtatcgtcaagttcatcatttaataggcacaccgccacaaatcctcattcatcttgaagaatgaacttagagatgagattttggaagtgtacagtgtgatacgtatgagtggtgtgtattggtacattaagatggataaagatggaaataaaatggagagaaagaaagagagagaggaggaaaaatagaacatgctgctgaatagtatagggtaaccggccccatgacttagcaatacgcaattactgaaaagctccaaccctcctcccaaccatgagccattaatgtcttaagagaatcaggccatcactacagctgtgccatcctccctagcaaatgcccctacgcgttctcaatttggaggacactttttggtcaatttcggtgacgttcatactttgcctagagacaaaatattgatcaatattacaagctaaccgatagagactgattaagagctttaactgtatttggatgcccacttagtttttggagctataagtaggtgcattggagttgggaaaaataaaggccag

SEQ ID NO: 66 - DNA, 456 bp, Zea mays; identical to SEQ ID NO: 40

SEQ ID NO: 67 - DNA, 2980 bp, Setaria italica
gaacgacggaaactgctagcgtaactatagaattctggaaaggataggcacgtcgtttttcagtccactccgtacagcgacagaaacagacgtctctcaaaaaatcagtacaggtgtaatgacatttacagccacgaaggatcgttttctttgctatacatactcaggtttttctctacttatactaatctttcgctaatttatctctgaccagtaaaaggctgtgtttcctattgtgcgcagaaagatcagaccacacgccaagagccgtgccgaggtatatatggaaacagtacactactatctgcagcagtgcagcatcgatttcttcgccccttctcctgaaaagtcgagatataaaaagatggagaaaacctcggtcaaatttggattagttgcatgcatgcatgcatttcatcgcgaggattacctccgttttaaaatgcttgacatgattttcaaaaccacatttaacaatttgtcttattaaaaatcaatatattatgtaaaaatataaattatatttaaaatatatttaataataaaacaagtcacaattaaataaactatactccttacataggtttataggtttctgaaatctgaacaagacgattatcatgtgcagagtccaaacgtcaacggtgtaaaacaaacacttgaaacccgaagtaaatataccttcatccaacaacattgacaatactactacttcctccgtttcaaattgtaggtcattttagcttttctaatattattatgcatccagacatacactatatctagtgcatagaacaactatacgcctagaaaagtcaaaacgacctataaaggtataaaggagtggtagttgcttatccaagatgattagcgaattgcatcttagaagtggataagatgcttaaatttgcaccgtactttggtacacatggtagctttcctcatgggaattaacttcaaaccgctcttatgacccttcaagtacttgtgtttaagcacacaccttgcattttagatgccataatatacatttttttgtcctttttaaggcattcattttttttagttttgacttgttttgttattgtattactatcacaagccgatgatgcatcatgcatgtaattacctgacctatttcactcaggctatttctagtggagagtttcatctcacagtttccaagaatgacatgtcatcaaaagaggtttgatttctagtggagagtttcacctcacagtttccaagaatgacatgccatcaaaagaggtttgagttgatgaatgaaacaataccccccaatgcagagttttatttcacacccataccatttaattgtgaggcctgtgattggatatgctaagatgaaatgaaactctatagccccaaatgcaagtttcaacaggtttcgtagtcttgaaaacagtgcatacacagtttcatcttgagagcaagtttaataacgcagctagcaagcgggctgcaaggtttctctcagccttttcctagcccactcgtacaatggttaactcttcaccattaatacatgatccacaagtcattctcacaaagtttcttggttcctgtgcccaagtcggctataagcttatagcccgcttctcctctctcacctcttctctctcctccacgtcagcattcagccagcttacagcctcttattatacttgctctgatgaaactcttttcctctctcacttcataattaccttgccatgttatcaatgtgtcatcgtatttaacgtatatgaaatttctatgaaacttgcactggactagcttttttgtttttgcgaaacaccgtcgacatcgagagcagtgcttagttggctgctgttcacacaggtcatcaaagaaatgaagcactgctttaaacatttgctcttatacttggctacaatggaagaggcacctaatttggacgctccatatgctatacgatgaatgtaaaagtagcagtggagaaccgagaacctcttccttctccatcactcaataactacggcggttatctagtcttaaaaatttgtcaacagtgcattattcatgaacaggacgtacgtccactgccaaacaatctcgtagccggaaattaaataaccaagaaaaaaatgaaaaatacaccggcaaattaaattatgtaagcctatctttacatggaaaatgcatgattgggcttgctgccttcgtcaattttctcctttatggctgtacacatatatagcttgaaataaatatgtatgacatgcagatatatgaacgtttattttcacattttccacgaaaaaaagtatataatgacgtccaataaatccaaaatacatgacatatttcgcatatttcgccgtattgtagcacacatattgttgacgaaaataatataaaaatcatgcacccgtctcgctctctctctcctagcaattacgatacgccctctcaataaatgcggattgcaccacctcaacactcgtccgcaataactccttcccctcttcctccacattctcttccacctccgttcccctttcttctcttcctcttcctcctcctcctcccttccccttccatggctgtctagctcctcaggatctctccgtctctccacttcctgctagctacccttctgagcttgcacgcggtaaagaatcatctcgagagctgcaacttgcaggcagacatagagagagatcagagttctatttttgcaaaggcgcacaacatatatagttcttctgctagatctcactgccagtctcacagagcgaaggtttatttgggctagtttgcccctagatctgttgctggctgtgttgttgcttggcaggcaaggtatctctatataggaataggattagcgcctgttctttggctgtagagagagagagttgtcctatgtgtctctgaagaaatggaaacgaatgagacggcaagaaattagggtttgcgaggtggtcagaggaga

SEQ ID NO: 68 - DNA, 2500 bp, Setaria italica
gaacgacggaaactgctagcgtaactatagaattctggaaaggataggcacgtcgtttttcagtccactccgtacagcgacagaaacagacgtctctcaaaaaatcagtacaggtgtaatgacatttacagccacgaaggatcgttttctttgctatacatactcaggtttttctctacttatactaatctttcgctaatttatctctgaccagtaaaaggctgtgtttcctattgtgcgcagaaagatcagaccacacgccaagagccgtgccgaggtatatatggaaacagtacactactatctgcagcagtgcagcatcgatttcttcgccccttctcctgaaaagtcgagatataaaaagatggagaaaacctcggtcaaatttggattagttgcatgcatgcatgcatttcatcgcgaggattacctccgttttaaaatgcttgacatgattttcaaaaccacatttaacaatttgtcttattaaaaatcaatatattatgtaaaaatataaattatatttaaaatatatttaataataaaacaagtcacaattaaataaactatactccttacataggtttataggtttctgaaatctgaacaagacgattatcatgtgcagagtccaaacgtcaacggtgtaaaacaaacacttgaaacccgaagtaaatataccttcatccaacaacattgacaatactactacttcctccgtttcaaattgtaggtcattttagcttttctaatattattatgcatccagacatacactatatctagtgcatagaacaactatacgcctagaaaagtcaaaacgacctataaaggtataaaggagtggtagttgcttatccaagatgattagcgaattgcatcttagaagtggataagatgcttaaatttgcaccgtactttggtacacatggtagctttcctcatgggaattaacttcaaaccgctcttatgacccttcaagtacttgtgtttaagcacacaccttgcattttagatgccataatatacatttttttgtcctttttaaggcattcattttttttagttttgacttgttttgttattgtattactatcacaagccgatgatgcatcatgcatgtaattacctgacctatttcactcaggctatttctagtggagagtttcatctcacagtttccaagaatgacatgtcatcaaaagaggtttgatttctagtggagagtttcacctcacagtttccaagaatgacatgccatcaaaagaggtttgagttgatgaatgaaacaataccccccaatgcagagttttatttcacacccataccatttaattgtgaggcctgtgattggatatgctaagatgaaatgaaactctatagccccaaatgcaagtttcaacaggtttcgtagtcttgaaaacagtgcatacacagtttcatcttgagagcaagtttaataacgcagctagcaagcgggctgcaaggtttctctcagccttttcctagcccactcgtacaatggttaactcttcaccattaatacatgatccacaagtcattctcacaaagtttcttggttcctgtgcccaagtcggctataagcttatagcccgcttctcctctctcacctcttctctctcctccacgtcagcattcagccagcttacagcctcttattatacttgctctgatgaaactcttttcctctctcacttcataattaccttgccatgttatcaatgtgtcatcgtatttaacgtatatgaaatttctatgaaacttgcactggactagcttttttgtttttgcgaaacaccgtcgacatcgagagcagtgcttagttggctgctgttcacacaggtcatcaaagaaatgaagcactgctttaaacatttgctcttatacttggctacaatggaagaggcacctaatttggacgctccatatgctatacgatgaatgtaaaagtagcagtggagaaccgagaacctcttccttctccatcactcaataactacggcggttatctagtcttaaaaatttgtcaacagtgcattattcatgaacaggacgtacgtccactgccaaacaatctcgtagccggaaattaaataaccaagaaaaaaatgaaaaatacaccggcaaattaaattatgtaagcctatctttacatggaaaatgcatgattgggcttgctgccttcgtcaattttctcctttatggctgtacacatatatagcttgaaataaatatgtatgacatgcagatatatgaacgtttattttcacattttccacgaaaaaaagtatataatgacgtccaataaatccaaaatacatgacatatttcgcatatttcgccgtattgtagcacacatattgttgacgaaaataatataaaaatcatgcacccgtctcgctctctctctcctagcaattacgatacgccctctcaataaatgcggattgcaccacctcaacactcgtccgcaataact

SEQ ID NO: 69 - DNA, 3000 bp, Vitus vinifera
tcagactgtcttgagccatcatcatcatagtttaacccatggttgtaaaggatccaatcagagtcacacgctgcacgcgcgcgcacacatttagagggattcctttttgtctagattgtaaaaattataatttttacgaattactatagaattaagacaaaatagtaaaagattcctacctggcactgtaatttttcactttacacgtggtaaattagtctgacatatacagtgcacgctcatttttaacgcatgcatgttagtccaccttcaagcagaggctagatgctatgttcgattcaaaaatcaaaacaaaaaggttgtttcacattatgtccgatttgaaaaaccaagaaagaaaagaaaatcttgtttcatgtagaaggagataaaattttaggcaaagatcaaaatttggtaagaagtaacataattgttggtttgtttatcaaatatggcaagctttacacggtaatatgcaaccaatatatgcataattacatttgtatgtagttaatagcataatagcatgcagctaatgtgtacactcttttgatatgtacatatcacactacaccatggtgcaagaatgttagagcatatatagaaatggggggtttcatgaattacaaatatttggtaagcttgttatctaaaggcaatattaggttgatatttttttcaatttggtgagggaacaaaactgccttattaacaatatccaaatttatgattgagtggaataagaaaaattaagggtgccctgaagacagccattagcccacagattttggtacaataagatacgttatcaagctaagagatttgtgcaagggaggcatgaatatagtaaatgatttattctgcatgcagaccctgctcgtggctcaggcatttaatggaatattgctagggagaaggaggagagatggggctaaaatgcttcatcacagctccacctccacctcctcctcctgataattccctttcttaattccctcacatacccacatgtaataatagatctttgtcacggggattggtgccaaaaacatcatatttggaacattaactattaatccatgttttccatacatgttactcacaaaatcttctgtttatacaataaattattggatgcatgtagcaaaatccttttaaggggtgattcattagggcaaatcgtgctttatggacatggaagttcaactcaattgaggcgtaaacagtgaaaacagtgtcacaaaacaaccatttgtaaaagcttaaaaggtactgtatatgagaagcgattaatgatatacaaacaaggagagaaacaataaaagaagtttgaaaaggagttggagaaaaggtgatgggagaatgagaaaaaaaaaaaaaggaataaaagaaaaagaaagagttgaaaggagtgctgcagttaagatgggtgtaattggcttcaccatacacgctctctcaaagacatctaaacatcaaacgcttatatgcttctgtatttctatatatatttctctctccttagcaattacacctccatccaccataaatgctattgcaccctctcaatacgctctgcaataactcctcgctgccacatcttctccacctgttaccctttcttcttccctttctcaccttctccaaagctctctgcctttcgagtctatctcctctttttcgccgtccctttattctccctctctctctctgcctcttcctctctcagtgttcttctcaaaacctgttactctcatctaaagctgccagaaaaccactctttcagcgcccaaaaagtggttttccggtgacccaatagtctctaaaacagatctgccactttgctcactggacttgaccttcatcttcaaaagggtcgttttgcttttctcccatagcttccgcacctgtaagttattttgaccccataggtcttctccatttttcaccagtctttatttatttttatttttttttgagtggggggtctaaatggggttgcaacaccatcattctcatccttaactgtcttgagacacaagattttttcacctttctttgcatattttattaacttctgagtttttgctctattttccgttatcttttttgcagtagagaaagagcaaaggttgaggttgaggttggacgcaccgagatcttcgtgggcgttatggtttgaaattggtgtttcaaagcccattccatactgtccactctatcttccatttttctccagtaagagctttgtgacctacgaacagaaatacagggtcaagatcttctttcaaagcccaaagccacagttgtagctcctccactgctgcatgtttagggtttgtgggggcagtgacacttcccggccggaataatgcttccggctaatgactggccactgccaattgaaaggaacctaaaggttgctggatttgggttgtcatcaggactaattctaagcgtggtaagccttcgtggcagtccaagttctattgatgtccatttcatggactgtgagtctgtgaagactgttagggttgtctgggtttgggtttttcttttatcattttcttagtcatttcattgtttcctcatctctcttttttctttttctttttctttttctaaatatatatacatattcaagatcaattagattagtagagggtttttgctaggcattaaggtatttcaagaaaaatcattctcgatacaaacgctaaaaagctgttttgcagatgagagagagagtcttctcataaacaggttttcaaaagtgggatagggatccataacctaagaaaattaattcactgcttaatactatgtacagatttccacacatgattaattcttttcttcttaattcaaattcttgagggtttttttttttttttttcattctttacatgggcttcttccttttgaagtggttgactcatttcattctcttggcagattgaagaaccctagctttggaatcataaaggatctgtgaat

SEQ ID NO: 70 - DNA, 3134 bp, Populus trichocarpa
aattaatcttttttttgtttgatttagttcgttaatattaattttttttctatttagttatcacactctcaggatacggatcccaggtttgacgggttaacccagttgattcagaatgtttttctttttaatttggtttgcataatttttgttagagtttttggattcatacatgtgtttggaaaacacccctcaagcctatttttagtggttttattacaaagaaaaatggatgtttggccaaacaaagcctaaaatttttttaaatataaaaaaacatcttttttcttgcatatggctaaaaactcctaaagttatttaagcatttcttttataaaaaaaatttaaaatacttttatatgttttttctaaaaaaaacatattgcataaattttacaataagtttgtaaaatttctaaggattttggcctacatttcagaaatacaaaaaaaaattattttgtttcttttaatatgtgagattatgaacttatatgtaagacttattcctgctattaaataaaaaacaattttttttatattggcactagaacgattaagtttttaacctgataagatgaagaccttcttacagagaaagacttttcttaaaccctagaatgaccaacggttagaaaacacaacattaccttagtttacgttagacaaataaacaatacagtttacctcaggtacgacgtattaggggtgttaatacctttcttttatacaatcagttctcttccccagactcagagaccagttagggtttctagtgatcaaaatattaagtgacaactttcatttcttttttttttctactgataaaagacaagtacccttcttcttcttattttttttttaatgttgtcaatttatttataaataagagacaaaaaaaagaaaaaaaatattgtccatttattaaacaaattgttatctaaatttgtgtgtgtataatcattttcatttattagataggcatttcttacaatgattttaagttcatgtagactttaatttattgtgtgttatatgtgatatatatttcacaactcatgaaaattataatgattttgtaagataacatctcctatttctgaccccagaaaactcctagatatattctcattaattacgtttttatttaaacaataataataataataataataataataataaataaactatatatatagtttatttattattattattattattattatatatataatttgattgtgtgtataatttagccatattttttcttcgttaatcatgttgttcctaactaggcatcaagaccacaaaatcatgaggaaattatgatttcatacacgaatattgatcatctacgtacataaatttttgcactggtgaagcaacaacaatggtggaaatttggaatccaagaagccgtaattcacaccaccatacttctagaggaaatttaaacatgaaataatgatcgctccttttcatctctttctcactctctcgcatttacacctctctcccaccataaatgctagcaaaccctctctatacgctctgcaattactcctctgctgccacatcctcaccacctgttccctttcttcctttctcagcttcttcaaaaccttataatttgtctcctccttttcctcttccgtttctctctctgtgtgtgcccttttttctcccatcatagtttaatcatacagtcatcttaaaacccttttcagaacatagggtctctcttcaaaaaccagccagtaaaccacttgtctagccctaaaaactggttttgtagagacccaaaacctcttccatcacaaatctaatccttgtttccatggaacttcaaaggcttctatattttggtaagttgcacaccttgtctataaaacctttcaattcatttctcttcaccataagattctctcattttcagttttatatcatgtcctaatctttttcctaaacataaaaatggtgttttttattattttttgtgcaggaattgaaaatgtcgagtgggatggattgacctagatcttagtgggcgttatagtcttggtaatggtgtgttgaaatttatttgtcaaagcttcagagaggggtccatttagtgtcaactcttcatgctcatttgtttttttatataattttaatcttttggaacgtaaaactagaaaggacttgagacttttctttgaagttatgacccaaacaccctacagtcaatcctcctctcttactacttttctttgatgttatgaccgacccaaacaccctacagtcaatcctcctctcttactacttgtaataatctttttttttggcttttgctcaaacatcttgagagaatctatttcgcaaaccaaccccacatacagccaacgtaagcagcaaaatcaatcatgtcatatcctcaagagatagaaagagagaaagataaggatgctgcttagggtttgttggtgagagtaagatatgccttctacaatggagtttaaaggagaaaaaggttgtcagatttcaatcatcctctaaggttagtcaatcaggtaaggttcctctcactttggttgaggttcttaaaaagtgtttttattcactaaatatgcttaaacaaagtaattaaaacgtttccaagcaacatccttcttggaatgaacgcataacgcttttttttttttgagtaaaaagagagagagagagagagagaagagagaggaagataaaaggtgttatcttgcttatctggtgattagccatctcttgtaactacagctacgacagtgtggaatacacttcaccttgccctacaaatttcaaacaacatttattatgttgggaatttaacttggttttgctttttttcctccttgtactcttttttataattcatcaatgtttcctatcaataaatctttccatatagatgttaatttcttatctacaaacatctcatatatagcctttaatacttttctttacttgtacacatgatttactcacccctttagcatgtttacatggcattccttaggattattcttctttttttatttgcttatttatgattttttatttgcagattggaaggacagcttagcttaaaatttaagggatttatacaa

SEQ ID NO: 71 - DNA, 3091 bp, Populus trichocarpa
aattaatcttttttttgtttgatttagttcgttaatattaattttttttctatttagttatcacactctcaggatacggatcccaggtttgacgggttaacccagttgattcagaatgtttttctttttaatttggtttgcataatttttgttagagtttttggattcatacatgtgtttggaaaacacccctcaagcctatttttagtggttttattacaaagaaaaatggatgtttggccaaacaaagcctaaaatttttttaaatataaaaaaacatcttttttcttgcatatggctaaaaactcctaaagttatttaagcatttcttttataaaaaaaatttaaaatacttttatatgttttttctaaaaaaaacatattgcataaattttacaataagtttgtaaaatttctaaggattttggcctacatttcagaaatacaaaaaaaaattattttgtttcttttaatatgtgagattatgaacttatatgtaagacttattcctgctattaaataaaaaacaattttttttatattggcactagaacgattaagtttttaacctgataagatgaagaccttcttacagagaaagacttttcttaaaccctagaatgaccaacggttagaaaacacaacattaccttagtttacgttagacaaataaacaatacagtttacctcaggtacgacgtattaggggtgttaatacctttcttttatacaatcagttctcttccccagactcagagaccagttagggtttctagtgatcaaaatattaagtgacaactttcatttcttttttttttctactgataaaagacaagtacccttcttcttcttattttttttttaatgttgtcaatttatttataaataagagacaaaaaaaagaaaaaaaatattgtccatttattaaacaaattgttatctaaatttgtgtgtgtataatcattttcatttattagataggcatttcttacaatgattttaagttcatgtagactttaatttattgtgtgttatatgtgatatatatttcacaactcatgaaaattataatgattttgtaagataacatctcctatttctgaccccagaaaactcctagatatattctcattaattacgtttttatttaaacaataataataataataataataataataataaataaactatatatatagtttatttattattattattattattattatatatataatttgattgtgtgtataatttagccatattttttcttcgttaatcatgttgttcctaactaggcatcaagaccacaaaatcatgaggaaattatgatttcatacacgaatattgatcatctacgtacataaatttttgcactggtgaagcaacaacaatggtggaaatttggaatccaagaagccgtaattcacaccaccatacttctagaggaaatttaaacatgaaataatgatcgctccttttcatctctttctcactctctcgcatttacacctctctcccaccataaatgctagcaaaccctctctatacgctctgcaattactcctctgctgccacatcctcaccacctgttccctttcttcctttctcagcttcttcaaaaccttataatttgtctcctccttttcctcttccgtttctctctctgtgtgtgcccttttttctcccatcatagtttaatcatacagtcatcttaaaacccttttcagaacatagggtctctcttcaaaaaccagccagtaaaccacttgtctagccctaaaaactggttttgtagagacccaaaacctcttccatcacaaatctaatccttgtttccatggaacttcaaaggcttctatattttggtaagttgcacaccttgtctataaaacctttcaattcatttctcttcaccataagattctctcattttcagttttatatcatgtcctaatctttttcctaaacataaaaatggtgttttttattattttttgtgcaggaattgaaaatgtcgagtgggatggattgacctagatcttagtgggcgttatagtcttggtaatggtgtgttgaaatttatttgtcaaagcttcagagaggggtccatttagtgtcaactcttcatgctcatttgtttttttatataattttaatcttttggaacgtaaaactagaaaggacttgagacttttctttgaagttatgacccaaacaccctacagtcaatcctcctctcttactacttttctttgatgttatgaccgacccaaacaccctacagtcaatcctcctctcttactacttgtaataatctttttttttggcttttgctcaaacatcttgagagaatctatttcgcaaaccaaccccacatacagccaacgtaagcagcaaaatcaatcatgtcatatcctcaagagatagaaagagagaaagataaggatgctgcttagggtttgttggtgagagtaagatatgccttctacaatggagtttaaaggagaaaaaggttgtcagatttcaatcatcctctaaggttagtcaatcaggtaaggttcctctcactttggttgaggttcttaaaaagtgtttttattcactaaatatgcttaaacaaagtaattaaaacgtttccaagcaacatccttcttggaatgaacgcataacgcttttttttttttgagtaaaaagagagagagagagagagagaagagagaggaagataaaaggtgttatcttgcttatctggtgattagccatctcttgtaactacagctacgacagtgtggaatacacttcaccttgccctacaaatttcaaacaacatttattatgttgggaatttaacttggttttgctttttttcctccttgtactcttttttataattcatcaatgtttcctatcaataaatctttccatatagatgttaatttcttatctacaaacatctcatatatagcctttaatacttttctttacttgtacacatgatttactcacccctttagcatgtttacatggcattccttaggattattcttctttttttatttgcttatttatgattttttatttgcag

SEQ ID NO: 72 - DNA, 3940 bp, Medicago trunculata
tgattactctagagagtaagttttttccaacacatccaactaatatctctatgaccactcttcatacaacaaggaacactcacacacagtaagaaggcattgcgaaactcggtctaacttgttctcttctaggccactatttcaaaacaaaaaagtttctcacaaacaattgttttttaagaaattaatatgggatatattaacaacaacgataagctctttagtataaggtgtactagagaaaccatctaaaaaaataaactgtcatataaagtgcgtttgatttgctaaaaaaatgaaggacaggacagaacaactctagttgtccagtgtttgatttgtaaaactgtttcaggtacaggacaaactggaggcaagggacaggacaaaaactcatatttttgtccctcaccaaaccacaacacaactttttgtcccacgtacaaattgtctaaaataccaaaatagtattttgtccctaaaaaatcgtaaaacaaaaaaattactcaatgccataaaaaatttgtcatgtgttgttctgccttgtgttgtactgttctatcttgtactgttctgtccagtacttgttgttttgcaaaccaaacacacccataaagtatatacaagaacaaaggctagtcaatacccatacaaagcaaatgatccgactaccatctctgagaaccgtacacaaacgtggcgttattagcttttaaccaccaaaacgaattaaatttaatttatctaagagttataagataggagtttcaatgttgttgaatagcctattattgcgatcattctcacaaataataagtataatctgtatttttttttgaaggaagtataatctgtacttaatggatccaaaagttaaccataagtaactattaatttcggttggacattttttgtaacatatttacccttaaaacaccgttcttttaaaatttaaatgtaaatatacatcataattaaataggtccttaaaaaaaatcataactaaataggactattaaacaaattacaaatttaacaacaatacagttcaatccaaattcaaattttaaaaaatataaaacatgattattgaaaaataaatttagattaagatatcttgtacaattatcttatcttttttatctgaataattgtactcgtcttatctttttttaaatcatagcttgtgtacccttaaaaaaaatcataccttgtgtaaaaattcataatcatatttacatcgttccttttcattttataactaatttcttttcttttgattgcagggattgattcttcaataacttcgacaagaaagtcgttaggacgaacactttaaattgaaagacaactttcatgacgacatgttggtacttgtgaaagtggaggaatataactattttttaagctaatttcatccgctcgaacaacccaatttctttaattcggagattcgtccaagatattgaagactgtaacttggagcatcttcatattggtgcattgttgaaggacatcatctatataagttggaagcggcctcaagaaggttggaccaagctcaacatgatggtgcttgcaaagatacgagggttattgctggatgtggcgatctttttcgtgattcagacggtagatggatcaaaggctacactaagaagattggagcttgtgatgccttatatgttgagattttgatcgacatgatttctgataatttcaagttcaatgagaatattcctgttttagtttaccggatctgaaagttgccgaagatgagttgaaatgttcaactcaaccatacttgacgtgaaggaaataggagtgctgattggctcgttaacttaagcatttctacggatcactttaatttactaatgttggagtctccttctagcgaggtccaaagaatccttttagatgatttatccaggacttgcatgcctaggaatcttcgattagctttttagttctatttttttttctttgccctcttgtaaaaaaataaaaataaagatctttgaaagtacagaatgtatttatatatgtaatttttttcctcaaataccaatatatactactagtataagtagagtatatttacattatcgtagagtacgtgaatgaatataagtaaattcagtagggaagagtaaaaattaacgagtttggtagccgtcatcttttgcaccatctactctcaaatccaattttttttactacacaacacaataatctctctctctctctctctctctctctctctctctctctctctcacatagtctctctcatgtacactactagcaattactacacctcttacgcccaccattaaatgcaattgcaccatctcaatacactcagcaataactcatcactgccacaattttcctctccatccgttcactcttatttcctttctcttccttcaattcctttgtcctctcaccttcttcatcgtcttcatcttcttttcttcttctttctctctttaaacaatctactaccttttttaagctagaccgtccaaaaacactcatcaagctttcgttgcttaatttattaccatatacccaactttccataacttcctcaaaaaaaccttctcttcttttttcatattcatctttgaaaaaagtgtcttttctttttacttctttttgtgcaccatagtagatctacattttttcttcctcttctagcttctatctctctttagcaactacccttcctcttggtaagtggaaaaaaaaagtctttgttatcattaattcatttcacatctcattcacaccaatatcattgtttttgtaaaactaaatctgttcacaagtttttttcttttaaaaatacttatgtctccgtccatatagttagggttgctagaatgtcatatatttattttttgtttttttttccatcttttttctttctttctgattatgcttgttcctatgctgatttcaaatataacaaaagaatttaacatgcattttaattatgcttaaaaattcttagaagcataaagaaaaaaaatctggactttgatcaccccaatattttttagtttttggttataaagtgaggtcacgtttttatatttgagtatttttttttctctcatgttattgatgtttttgtttcctttttgaagtggcacattaatctcattgaaacaccgctaaagctgacagaagaatctaacaaagaattcatcatctgaaagccatttaaggatctaagaaaagagagagaaaaaattaaaagaaggattttctagttgaagcttttttgattgaaatatgcaagctggtttaatgattccagctagtaacatgcattcaatgatcggaagaaacaacaataacgttggtgtctttggtttatcttcatctctctctttatcccaggtgaatcttcttgtttttttttttccttcacatttctatcaaaatttttagtatattaaattaataataataataacaattttgttctaatgttaatttaatttgataaagggtcatctattttgactttatctttgcaaagataattattttctcttaagtcaacatttggtctttattgaaagaacaacctaaacaaacaaaaaaacctttcattgtattttaccagtccaagtatccttctcgttattcggaaaccgcgttattccttttcactttttcactatttaaattcattttcctcaaaaacatcaacttagtcaaattcacatgtttttctttttcatcaagtttctccaatttaattagaaaaaataaataaacaaaaattgtttttgttgattttgttttttgttgttgttgaatgtactatgtactatgtatgtactatactatatattatgtgttaaattgtttttgttagattgaaaacaataagcatttggaatcttaaagatctgtagaaa

SEQ ID NO: 73 - DNA, 3897 bp, Medicago trunculata
tgattactctagagagtaagttttttccaacacatccaactaatatctctatgaccactcttcatacaacaaggaacactcacacacagtaagaaggcattgcgaaactcggtctaacttgttctcttctaggccactatttcaaaacaaaaaagtttctcacaaacaattgttttttaagaaattaatatgggatatattaacaacaacgataagctctttagtataaggtgtactagagaaaccatctaaaaaaataaactgtcatataaagtgcgtttgatttgctaaaaaaatgaaggacaggacagaacaactctagttgtccagtgtttgatttgtaaaactgtttcaggtacaggacaaactggaggcaagggacaggacaaaaactcatatttttgtccctcaccaaaccacaacacaactttttgtcccacgtacaaattgtctaaaataccaaaatagtattttgtccctaaaaaatcgtaaaacaaaaaaattactcaatgccataaaaaatttgtcatgtgttgttctgccttgtgttgtactgttctatcttgtactgttctgtccagtacttgttgttttgcaaaccaaacacacccataaagtatatacaagaacaaaggctagtcaatacccatacaaagcaaatgatccgactaccatctctgagaaccgtacacaaacgtggcgttattagcttttaaccaccaaaacgaattaaatttaatttatctaagagttataagataggagtttcaatgttgttgaatagcctattattgcgatcattctcacaaataataagtataatctgtatttttttttgaaggaagtataatctgtacttaatggatccaaaagttaaccataagtaactattaatttcggttggacattttttgtaacatatttacccttaaaacaccgttcttttaaaatttaaatgtaaatatacatcataattaaataggtccttaaaaaaaatcataactaaataggactattaaacaaattacaaatttaacaacaatacagttcaatccaaattcaaattttaaaaaatataaaacatgattattgaaaaataaatttagattaagatatcttgtacaattatcttatcttttttatctgaataattgtactcgtcttatctttttttaaatcatagcttgtgtacccttaaaaaaaatcataccttgtgtaaaaattcataatcatatttacatcgttccttttcattttataactaatttcttttcttttgattgcagggattgattcttcaataacttcgacaagaaagtcgttaggacgaacactttaaattgaaagacaactttcatgacgacatgttggtacttgtgaaagtggaggaatataactattttttaagctaatttcatccgctcgaacaacccaatttctttaattcggagattcgtccaagatattgaagactgtaacttggagcatcttcatattggtgcattgttgaaggacatcatctatataagttggaagcggcctcaagaaggttggaccaagctcaacatgatggtgcttgcaaagatacgagggttattgctggatgtggcgatctttttcgtgattcagacggtagatggatcaaaggctacactaagaagattggagcttgtgatgccttatatgttgagattttgatcgacatgatttctgataatttcaagttcaatgagaatattcctgttttagtttaccggatctgaaagttgccgaagatgagttgaaatgttcaactcaaccatacttgacgtgaaggaaataggagtgctgattggctcgttaacttaagcatttctacggatcactttaatttactaatgttggagtctccttctagcgaggtccaaagaatccttttagatgatttatccaggacttgcatgcctaggaatcttcgattagctttttagttctatttttttttctttgccctcttgtaaaaaaataaaaataaagatctttgaaagtacagaatgtatttatatatgtaatttttttcctcaaataccaatatatactactagtataagtagagtatatttacattatcgtagagtacgtgaatgaatataagtaaattcagtagggaagagtaaaaattaacgagtttggtagccgtcatcttttgcaccatctactctcaaatccaattttttttactacacaacacaataatctctctctctctctctctctctctctctctctctctctctctcacatagtctctctcatgtacactactagcaattactacacctcttacgcccaccattaaatgcaattgcaccatctcaatacactcagcaataactcatcactgccacaattttcctctccatccgttcactcttatttcctttctcttccttcaattcctttgtcctctcaccttcttcatcgtcttcatcttcttttcttcttctttctctctttaaacaatctactaccttttttaagctagaccgtccaaaaacactcatcaagctttcgttgcttaatttattaccatatacccaactttccataacttcctcaaaaaaaccttctcttcttttttcatattcatctttgaaaaaagtgtcttttctttttacttctttttgtgcaccatagtagatctacattttttcttcctcttctagcttctatctctctttagcaactacccttcctcttggtaagtggaaaaaaaaagtctttgttatcattaattcatttcacatctcattcacaccaatatcattgtttttgtaaaactaaatctgttcacaagtttttttcttttaaaaatacttatgtctccgtccatatagttagggttgctagaatgtcatatatttattttttgtttttttttccatcttttttctttctttctgattatgcttgttcctatgctgatttcaaatataacaaaagaatttaacatgcattttaattatgcttaaaaattcttagaagcataaagaaaaaaaatctggactttgatcaccccaatattttttagtttttggttataaagtgaggtcacgtttttatatttgagtatttttttttctctcatgttattgatgtttttgtttcctttttgaagtggcacattaatctcattgaaacaccgctaaagctgacagaagaatctaacaaagaattcatcatctgaaagccatttaaggatctaagaaaagagagagaaaaaattaaaagaaggattttctagttgaagcttttttgattgaaatatgcaagctggtttaatgattccagctagtaacatgcattcaatgatcggaagaaacaacaataacgttggtgtctttggtttatcttcatctctctctttatcccaggtgaatcttcttgtttttttttttccttcacatttctatcaaaatttttagtatattaaattaataataataataacaattttgttctaatgttaatttaatttgataaagggtcatctattttgactttatctttgcaaagataattattttctcttaagtcaacatttggtctttattgaaagaacaacctaaacaaacaaaaaaacctttcattgtattttaccagtccaagtatccttctcgttattcggaaaccgcgttattccttttcactttttcactatttaaattcattttcctcaaaaacatcaacttagtcaaattcacatgtttttctttttcatcaagtttctccaatttaattagaaaaaataaataaacaaaaattgtttttgttgattttgttttttgttgttgttgaatgtactatgtactatgtatgtactatactatatattatgtgttaaattgtttttgttag

SEQ ID NO: 74 - DNA, 3000 bp, Arabidopsis thaliana
acgtacgtataactccatctatatatctgtacctacatatatacagtaaaaatcagaaataagttgggttattgtttttttatatatagttattttaaagaatctaggtaaagtataaacttactgaaaagaaaaacttgagtgttaaagctatagctataaggactttaaaaaaaaaaacaaagcttaagaactaggtaattaaatacgcagtatatttctctatatattcgcgtgataaattaagatgaatgcatggcttttacaaattatcacctttttaatgggtgatccgtattttaaatagcttaattgcacgttatagttataaatgcttgggccacaaagtaattaatatttctaggcatgtaaaatgaagtcttactgtgaaaaaagtgatatttcattgacttccttaaattgaaaaaacaattgtttcgtaaacaaaactcaaaattaaggtgatgatttttagattttcttcttttaaatgaaataaaataaatacatcactcaatcaacttctgtctgactaacaataatacaacctaaacttctataatatttaagaaaatgccatgtggaagaagaatcatgaaattttccttctttacaattaaatttataacaaagatatgaaataataataaaataaaatagttaaaaatataatagtcatattttttgaaagtaaaaattaaatttatatctcataaagataaatattaactataacaagtcattgaattttagttaaaaaactatataatttttttccatattataaataatctaagagtattaaaatttcagaaaattacttttaaaattgtatccttgacaaatggggactattgtctaactttttctgtaaatggagaactgtattaaagcaaatttcaatatagttaaatctttttttaatatagttaattttgttaagtggtgatttattgcatatgcataagttatgaataatgctaatgattttttaaaaataactacatatctaatagataaatgtaagtctcataggctcatagaccgttagccgtcattcctcaccacattataatattttaaataaataaaaaataaaattattttaggttgacattgtatataagatgaaaaacaacacataattttgtaacataaataaaataaattgtaacatatctctctctctctatatatatataagcgtgtaggataattaagtgtccctctcgcaccatttaatttcattgcaccctctcaattctctctgtcattactctctcatctctcttcctccaagatttgcacctacctttcaaaccttttgctcgccaacaaaaccgcgcttcacaaaaccatcagcggttttccgagaaacaaatctcagaccagacaccgctctactcttctctctctctccctctagggtttcgtcgcttcttcctatatcccagtgtatgtctcgaaaacctcatcatttctgctgttttctttattttatccattaattcatgtacacaaatttatttgtttaaagtatcattggatccattacacttcagttttcttagcatctttataaaactctcactttcatgatgttttttttttataatttaatatatcctgtatgttgaattttcagttagtcatctatattttgtcttaaattttgccttctttagcattaattaattgatttcttgcctctaatatctttcattcctctcctaatttgctttctgactttctgatttattgtattcttctttaaataatcttatcaatttctgcatagtcagagatgaaaccttcaagaaaacaataaagaggaaagattaaaggttagtattcccttgcctaccaaaaaaaacagaaaggtttgtattctcttcgtatatccttattttcattatacgtttggttttatatataaacacgtgtatatactttatagtagtagtatacatttacatattaatgtgtgtaataaaaacgtttaaatacgatgatgatgataagaaatagctggaaaaaattaatacatcacccaggccttatgtcacgttggttgtaagttgtataataactatatgttggtccgtcgcacaggtgcacagatataatactatttttttcatttcaatttttttttctttcttaatcgccaaatagtagtttacactttttcctgaagagtttttattttttgaaaatctactaatgattatatttaattaaattttgttttgttctcacgaaaatattgtttttttaataaacaggatagagttgggaatttatttgtacctactttttcccattttatttgctttgaacaaatgagtccaacatttctcttttcgtcttctctttcctatcccatctaaatcaaaactgatcaaaatacctcgaaattttaaattaaatcaccatccatcaaagctattatagtgtagaaattttaaagttttttctttggacaacaattgatttccatctacactacatatgatatgactcttgaatcaatcatagtttttatttcagtctgctgattagtttttttcttttcttttaaaagggtaaaaaatcggtagtttcgaataattttgagtatgtgaaaattcattatttttgggttggttattcaataacaaattaatttgtgattgtgatgtcttttttatgcaaggctcttttttcttgctttcaattagtgggtcctttgtttcctacaatcatctccaattcttctgtttgcttatatcattttgtatgatcttcaagaagaaagataaacgactccgaagaaagatttaagttattgttgttcatacaaaaagaaggttgtaaagttgttgacgtggacaaaagtattgccatatttttccagcctcgaagaaatttcccttcttcttcaaaccctaaattttgacaaaactctctacttttttttgcttctagggtttgctttcagtttccggagtataagaaaag

SEQ ID NO: 75 - DNA, 3641 bp, Glycine max
tatatcatttgtttttaatgaagttatttttggtttagtttcttttaatgaagttactataaatttaattatagttgttcaaactaatatttagtccgaacaaaatacaaattggctaccgctatgcgctatctaacaaaattttccgagtcataacatgcagatgcatgcggttcaaaattaatacttgcactcatcataaaatttgttcatatataggtaagactttccacgtcaaatataaattaaagtgcatagaacaaaaataattaaattgcaaatgtattttatggtaaattgcaattctttataataatgtactatacaatatttatttagaaaacaaaatcttgcgttacgaattaatttttttaatgtagttacgaattgaattacacggttacaagtaccatgcatttttatatgctaagagaaattcatatttttaatcaatcttttacgaagtgactagcttacacggttacactacattgtaatcaaattatattatatgtagtatcttttttcttttataaaatatattactagtaagtatcttgtgcggatacttttaaacacaaagaaaatataaaaaatacaaaaatatataattttaaaaatataaaaatataatcaacagaatgatttttcttaataatttgaaaatattttatcatgcataatgttaataaaagaaactcaagtattaattaaagaaattaaaaaactaagaaccttctttaatatgattaattgaggaaatatatcgatttaacacatttcaagaaataaaaaatacatgcttatgtaaaatattaaaaatatatataaatgttatatctccgttaaaaacacgtttaaatttagagttcaattaaaatatattgaaaatgtttttttttgtagtattatctaatactgtataaattataccatgtaagataatattcttgattcttgtaagaattactttaaaaatatatctaaacggtttgtaatcatgcaatattataaattttcttatattccgtaaaaaaataatattttattataataatatataaaatcaaactcttatattcataatataggaaatagtagtcttcaaaaaaacaggaacgaataaatcatctcaatcttatcatatcaattattaattacctaatttctttaattaattaaattatcaataaaaaaaaggtgaactttggatcaaataatataaagttatttcaaattaaccaatgttgtaaaatttggatcttaaatatacagtcacattaactttgtaaacaatcttacgcatttgagcaaggttacttccgctgaaagatgtatataagatgaatttgtttaaagttttaaaagataactttaaaataaacattttttaagtaataaatatgggccaatttgtttaaacttgaaaaaataatttaaaaataagtacttttttaaataagtagatagaatttgtgtcagtttgtttaattttatttattgaaataaatgcttattttattaaaataaataactttctatttttttaatgtgttttcctaaattatttctacttgttttaaaaagaaaatatttgcaaaaagacatttatataaaaaaattatttttaagttttttaaaaaaatttaaacaaactcaccgtttgtttcttcaaataagcggatttttttaaaaatagaaacagttaaaaaaaataaaataaacataaaaataaatattttattaaaataaatacttattttaacaaataagtttaaacaaattatcacatgatttacttcttaaaaaaacaaaaaaaaactgtttattttaagtaaaaaaagtctagacaaacacatgataaaatcataaaactacttattttatttttaaaaaaatacttattttaaaaatatgctttaaaataattagctcataatttgcatcaaaaatcacaactcacgaattgggagtgaataaattaatagtaattagcttggctctttttcttattttttactccctattttccttttttataaggcttactagactcttttgcatgaccagcgtctctggtcaaaagaattaataataataataataataaaattcattaaaaatcacattaaaagaatattaataatcacattaaaaacatatttaaaatcacattaaagcacattaatgacattttcaatagtactaagaactctttcaattcttgaaccaatattactcttatcttaatggaaaatactctacacttatccgaacgaaaaaactgcaaaagagaagaagaaatgaatggagtgacacgcacaaattaatttcaagataccagcacttagcaatttagcatttgtttggtagccgtcattcgttgcattgcattgcatttgcatttgcattgcaccgtcaactcgcaaaatatttataagttttatactacaccaaaccaaaaaatatgctgcgtctctttctctctcccctctctagcaattacacctcttttgccctccattaaatgcaattgcaccctctcaatacgctctgcaattactcttcgctgccacattttcctccatctgttccccacttctctctctccttcaatgcccttgtccctctctcttcttcttcttcttcttcttctcactttctctctgtaacaccttctcttcatgatatagcttcttcaccttttttttctttcttttctttgttaccatatataagtaaactagattccataactgtcccaagcccttccttcaaaagggtcctctcttttcaacccaaaacagatctacaccttcatcttccaccaccactctcactggtaagtgctaaaaaatattgataataaaagcttctgtcgcaaccagggtcgcggcgtgtttgtgtggaacattcatgttttgttaaggttctctaaggtcacatttgtttttttttttttttaaacgaaactaatgaagctgtttggtacattttgtgagttctactaacattttccgggtgagtcgcttgcagctagggctgtgagaaaaggaacgttattaggtctgtaagaaaaaagaaaatatcctgaaatataggatgcgttgtaggattctccgagatcttcgtgttgttttattttataaataaaaaagttttgattttgttttgtgaaaaggcaaaagatcagataagggttacaatatttcttttcttttttattctgtttacatatattgatgatatatatatgcatagcgtatatttgtttcgaaattttgataagtttttatctttttaattttttttcggccgtttgtataactgagttttgtagtaacacactgactcgctttgacattgtcatctgacagaatccaagggctcaacctcttaagctttttctctatccaagaacctcttaagagagagaaagaataagagaaagagaaagtgagagagccaattctacatttgttggtggtggtttttgaggcatgtgaaataatccaagggctcaacctcttaagctttttctctatccaagaacctcttaagagagagaaagaataagagaaagagaaagtgagagagccaattctacatttgttggtggtggtttttgaggcatgtgaaat

SEQ ID NO: 76 - DNA, 3509 bp, Glycine max
tatatcatttgtttttaatgaagttatttttggtttagtttcttttaatgaagttactataaatttaattatagttgttcaaactaatatttagtccgaacaaaatacaaattggctaccgctatgcgctatctaacaaaattttccgagtcataacatgcagatgcatgcggttcaaaattaatacttgcactcatcataaaatttgttcatatataggtaagactttccacgtcaaatataaattaaagtgcatagaacaaaaataattaaattgcaaatgtattttatggtaaattgcaattctttataataatgtactatacaatatttatttagaaaacaaaatcttgcgttacgaattaatttttttaatgtagttacgaattgaattacacggttacaagtaccatgcatttttatatgctaagagaaattcatatttttaatcaatcttttacgaagtgactagcttacacggttacactacattgtaatcaaattatattatatgtagtatcttttttcttttataaaatatattactagtaagtatcttgtgcggatacttttaaacacaaagaaaatataaaaaatacaaaaatatataattttaaaaatataaaaatataatcaacagaatgatttttcttaataatttgaaaatattttatcatgcataatgttaataaaagaaactcaagtattaattaaagaaattaaaaaactaagaaccttctttaatatgattaattgaggaaatatatcgatttaacacatttcaagaaataaaaaatacatgcttatgtaaaatattaaaaatatatataaatgttatatctccgttaaaaacacgtttaaatttagagttcaattaaaatatattgaaaatgtttttttttgtagtattatctaatactgtataaattataccatgtaagataatattcttgattcttgtaagaattactttaaaaatatatctaaacggtttgtaatcatgcaatattataaattttcttatattccgtaaaaaaataatattttattataataatatataaaatcaaactcttatattcataatataggaaatagtagtcttcaaaaaaacaggaacgaataaatcatctcaatcttatcatatcaattattaattacctaatttctttaattaattaaattatcaataaaaaaaaggtgaactttggatcaaataatataaagttatttcaaattaaccaatgttgtaaaatttggatcttaaatatacagtcacattaactttgtaaacaatcttacgcatttgagcaaggttacttccgctgaaagatgtatataagatgaatttgtttaaagttttaaaagataactttaaaataaacattttttaagtaataaatatgggccaatttgtttaaacttgaaaaaataatttaaaaataagtacttttttaaataagtagatagaatttgtgtcagtttgtttaattttatttattgaaataaatgcttattttattaaaataaataactttctatttttttaatgtgttttcctaaattatttctacttgttttaaaaagaaaatatttgcaaaaagacatttatataaaaaaattatttttaagttttttaaaaaaatttaaacaaactcaccgtttgtttcttcaaataagcggatttttttaaaaatagaaacagttaaaaaaaataaaataaacataaaaataaatattttattaaaataaatacttattttaacaaataagtttaaacaaattatcacatgatttacttcttaaaaaaacaaaaaaaaactgtttattttaagtaaaaaaagtctagacaaacacatgataaaatcataaaactacttattttatttttaaaaaaatacttattttaaaaatatgctttaaaataattagctcataatttgcatcaaaaatcacaactcacgaattgggagtgaataaattaatagtaattagcttggctctttttcttattttttactccctattttccttttttataaggcttactagactcttttgcatgaccagcgtctctggtcaaaagaattaataataataataataataaaattcattaaaaatcacattaaaagaatattaataatcacattaaaaacatatttaaaatcacattaaagcacattaatgacattttcaatagtactaagaactctttcaattcttgaaccaatattactcttatcttaatggaaaatactctacacttatccgaacgaaaaaactgcaaaagagaagaagaaatgaatggagtgacacgcacaaattaatttcaagataccagcacttagcaatttagcatttgtttggtagccgtcattcgttgcattgcattgcatttgcatttgcattgcaccgtcaactcgcaaaatatttataagttttatactacaccaaaccaaaaaatatgctgcgtctctttctctctcccctctctagcaattacacctcttttgccctccattaaatgcaattgcaccctctcaatacgctctgcaattactcttcgctgccacattttcctccatctgttccccacttctctctctccttcaatgcccttgtccctctctcttcttcttcttcttcttcttctcactttctctctgtaacaccttctcttcatgatatagcttcttcaccttttttttctttcttttctttgttaccatatataagtaaactagattccataactgtcccaagcccttccttcaaaagggtcctctcttttcaacccaaaacagatctacaccttcatcttccaccaccactctcactggtaagtgctaaaaaatattgataataaaagcttctgtcgcaaccagggtcgcggcgtgtttgtgtggaacattcatgttttgttaaggttctctaaggtcacatttgtttttttttttttttaaacgaaactaatgaagctgtttggtacattttgtgagttctactaacattttccgggtgagtcgcttgcagctagggctgtgagaaaaggaacgttattaggtctgtaagaaaaaagaaaatatcctgaaatataggatgcgttgtaggattctccgagatcttcgtgttgttttattttataaataaaaaagttttgattttgttttgtgaaaaggcaaaagatcagataagggttacaatatttcttttcttttttattctgtttacatatattgatgatatatatatgcatagcgtatatttgtttcgaaattttgataagtttttatctttttaattttttttcggccgtttgtataactgagttttgtagtaacacactgactcgctttgacattgtcatctgacagaatccaagggctcaacctcttaagctttttctctatccaagaacctcttaagagagagaaagaataagagaaagagaaagtgagagagccaattctacatttgttggtggtggtttttgaggcatgtgaaat

SEQ ID NO: 77 - DNA, 3000 bp, Sorghum bicolor
ttcactactttattattttctgagcaggaaaaagttatgtttcctttgcaaaaaatgggacccacacgcacggcaagaagccgtgccgtgccgtgccgcggcatggaaacagtactacactccaggactgcatgcactccgttgcagtgaaccatgcatcgatctcttcgcccgttcctctggaaactcataacttttttttttaaagagagaaacccctcaaacaaattaaattggatcatttgcacggatttcatcttgccggtcgtctgttgtgtatactgcaaatgagaattacgtattttgtggaagtccttcgtcttgtttttttatccttggccttgtttagtttcgaaaaatttcggatttcgctattataacactttagtttttatttgacaaatattgtctaatcatgaactaactatgatcaaaagatttatctcgcgatttacaaacaaattgtgtaattagtttttatttttgtttatatttaatgatttatgcatttgccgcaagattcgatgtgacggagaatcttgaaaactttttggatctctgagggaactaaacaacgcccttgtctaacacatgtatccccaatttcatcttgacggagggatataacgatcgagtcaaacctctgcatggatgggtgcactattggcgtgtagcagtatatggcgccaggaaaaagttaaaactaaagaaatggatcttttaacaagtactccctccgtcagcaacatgccggagctgtgtttaaagttagttttaatgaagttttattaaagttttatacatattaaatatgctgatgtaacattgtattgatgaagagagatgataaaaattttatgagataaagttttattctaataaaactcttctgcactatttctaaatatgactgcgttaaaaattgagtcatgaaatccgccgtcgaggatggcctaaagggcactcacaatgcagactctatcatagagtctaaggttatttattacctcgaacaatgtggacttagagtctaaataagacttggagtcttattttttctatctttttcttcaataaatataatgacatatcaacaaaatatcataaataatatgtaattaattgtcttagactctatgatagagttttgcattgtgaggctagtctcaatgcatgtttcatgagagtgtcatgcacattaaatagggtgtcacataagcaaaattgctgacttggcagggtcattaaatgaaggagtttcatcagatgagagagaagtttcatcctcatgaaactcatatggctcgattatctagtttatagtcttggtaactgtaccatgaaactatacattgacactggctgagtgtcctagcatggctcttatcctttggccagaactgaagagacgctatgtatatccatggctatctggaactttcctctctccatcactcagtaattacgccggttatctaatctgaaacatttgtcaatgtactgagtattcagcagaaaacgtaccacctgccgaagtactatatcgtagccgcgattaattgactaataagacaattgaaaaatagactgatattaccctcttagcctataaaagaatgtaactatgaaaccggtcaaactaatttaaatttaattagatttatagtaaataatattagtatttatatctttaaataaatttataataaaactgtattctataacaaacatatattctataactaatttaataatatttattttatataataatagataacattttttatataaatttagtcaaagtttaaacgatcgatctcgttacttaaaaaataaggagtagttagtatttttttattcgagttacagtactaaatgatatataagtctatctctacatggaaatgcatgatcatcgacttgccagcctttattttctcctctccttcatgatgactatacatagctcgaaaataaattaatatatatgtcatgcagatacatgaacgttcattttcacattcatttgccaaaaaaactacatatgacgacgtccaataaatccaaaacacatgacatatcgtgcatgtttctccttatatacaagtactataccaggccttgtttagttccaattttttttgcaaaatagaaatagtagcactttcgtttgtatttgataaatattgtctaatcatgaactaactagtctcaaaatattcgtctcgtcaatttcgtccaaactgtgcaattagtttttattttcgtctatatttaatacttcatgcatgcgtctaaagatttgatgtgatggagaatctgaaaaattttgcaaaattttttgggaactaaacaaggccccaatatacttgtagaaatagaaatatataataataaaaaatcatgcatccgtctctctctcgctctgctagcaattacgatacggcctctcaataaatgcggattgcaccacctcaacactcgtccgcaataactccttcctcccttctccacattctcttccacctccgtccgttcccctccccttcctcttcctctcctcccccttccatggccgccgcttagcttcgttctcaaggcctcctccctctcgccacacacctcctgctagctacccttctgagcttgcaaagttttgccgcatcacatcgatcttgagagctgcagcaggcagagatcgatcagagttctatttttgcagaggcacacaaacatatatagttcctgtatctgctagatctcactgccagccagctcgcagtgaagcttctctgggctaccttgtcgctagatctgttgctggtcgtgctgttacttggcaggcaaggtatacatctccatataggaataggattggcgccgcctgttttcttgggttgtgagggagatatactacgcatgtgccagtgaataaatgggaagcagctagtgaggaggcaataagaatcagggtttgagaggtcgcgagaggagaaa

SEQ ID NO: 78 - DNA, 2500 bp, Sorghum bicolor
ttcactactttattattttctgagcaggaaaaagttatgtttcctttgcaaaaaatgggacccacacgcacggcaagaagccgtgccgtgccgtgccgcggcatggaaacagtactacactccaggactgcatgcactccgttgcagtgaaccatgcatcgatctcttcgcccgttcctctggaaactcataacttttttttttaaagagagaaacccctcaaacaaattaaattggatcatttgcacggatttcatcttgccggtcgtctgttgtgtatactgcaaatgagaattacgtattttgtggaagtccttcgtcttgtttttttatccttggccttgtttagtttcgaaaaatttcggatttcgctattataacactttagtttttatttgacaaatattgtctaatcatgaactaactatgatcaaaagatttatctcgcgatttacaaacaaattgtgtaattagtttttatttttgtttatatttaatgatttatgcatttgccgcaagattcgatgtgacggagaatcttgaaaactttttggatctctgagggaactaaacaacgcccttgtctaacacatgtatccccaatttcatcttgacggagggatataacgatcgagtcaaacctctgcatggatgggtgcactattggcgtgtagcagtatatggcgccaggaaaaagttaaaactaaagaaatggatcttttaacaagtactccctccgtcagcaacatgccggagctgtgtttaaagttagttttaatgaagttttattaaagttttatacatattaaatatgctgatgtaacattgtattgatgaagagagatgataaaaattttatgagataaagttttattctaataaaactcttctgcactatttctaaatatgactgcgttaaaaattgagtcatgaaatccgccgtcgaggatggcctaaagggcactcacaatgcagactctatcatagagtctaaggttatttattacctcgaacaatgtggacttagagtctaaataagacttggagtcttattttttctatctttttcttcaataaatataatgacatatcaacaaaatatcataaataatatgtaattaattgtcttagactctatgatagagttttgcattgtgaggctagtctcaatgcatgtttcatgagagtgtcatgcacattaaatagggtgtcacataagcaaaattgctgacttggcagggtcattaaatgaaggagtttcatcagatgagagagaagtttcatcctcatgaaactcatatggctcgattatctagtttatagtcttggtaactgtaccatgaaactatacattgacactggctgagtgtcctagcatggctcttatcctttggccagaactgaagagacgctatgtatatccatggctatctggaactttcctctctccatcactcagtaattacgccggttatctaatctgaaacatttgtcaatgtactgagtattcagcagaaaacgtaccacctgccgaagtactatatcgtagccgcgattaattgactaataagacaattgaaaaatagactgatattaccctcttagcctataaaagaatgtaactatgaaaccggtcaaactaatttaaatttaattagatttatagtaaataatattagtatttatatctttaaataaatttataataaaactgtattctataacaaacatatattctataactaatttaataatatttattttatataataatagataacattttttatataaatttagtcaaagtttaaacgatcgatctcgttacttaaaaaataaggagtagttagtatttttttattcgagttacagtactaaatgatatataagtctatctctacatggaaatgcatgatcatcgacttgccagcctttattttctcctctccttcatgatgactatacatagctcgaaaataaattaatatatatgtcatgcagatacatgaacgttcattttcacattcatttgccaaaaaaactacatatgacgacgtccaataaatccaaaacacatgacatatcgtgcatgtttctccttatatacaagtactataccaggccttgtttagttccaattttttttgcaaaatagaaatagtagcactttcgtttgtatttgataaatattgtctaatcatgaactaactagtctcaaaatattcgtctcgtcaatttcgtccaaactgtgcaattagtttttattttcgtctatatttaatacttcatgcatgcgtctaaagatttgatgtgatggagaatctgaaaaattttgcaaaattttttgggaactaaacaaggccccaatatacttgtagaaatagaaatatataataataaaaaatcatgcatccgtctctctctcgctctgctagcaattacgatacggcctctcaataaatgcggattgcaccacctcaacactcgtccgcaataactc

SEQ ID NO: 79 - DNA, 1204 bp, Arabidopsis thaliana
atatcggttgttgacgattaaccatgcaaaaaagaaacattaattgcgaatgtaaataacaaaacatgtaactcttgtagatatacatgtatcgacatttaaacccgaatatatatgtatacctataatttctctgattttcacgctacctgccacgtacatgggtgataggtccaaactcacaagtaaaagtttacgtacagtgaattcgtctttttgggtataaacgtacatttaatttacacgtaagaaaggattaccaattctttcatttatggtaccagacagagttaaggcaaacaagagaaacatatagagttttgatatgttttcttggataaatattaaattgatgcaatatttagggatggacacaaggtaatatatgccttttaaggtatatgtgctatatgaatcgtttcgcatgggtactaaaattatttgtccttactttatataaacaaattccaacaaaatcaagtttttgctaaaactagtttatttgcgggttatttaattacctatcatattacttgtaatatcattcgtatgttaacgggtaaaccaaaccaaaccggatattgaactattaaaaatcttgtaaatttgacacaaactaatgaatatctaaattatgttactgctatgataacgaccatttttgtttttgagaaccataatataaattacaggtacgtgacaagtactaagtatttatatccacctttagtcacagtaccaatattgcgcctaccgggcaacgtgaacgtgatcatcaaatcaaagtagttaccaaacgctttgatctcgataaaactaaaagctgacacgtcttgctgtttcttaatttatttctcttacaacgacaattttgagaaatatgaaatttttatatcgaaagggaacagtccttatcatttgctcccatcacttgcttttgtctagttacaactggaaatcgaagagaagtattacaaaaacatttttctcgtcatttataaaaaaatgacaaaaaattaaatagagagcaaagcaagagcgttgggtgacgttggtctcttcattaactcctctcatctaccccttcctctgttcgcctttatatccttcaccttccctctctcatcttcattaactcatcttcaaaaataccctaatcacattttgtaacaataatacaattatacattaaaactctccgacg

SEQ ID NO: 80 - DNA, 2605 bp, Arabidopsis thaliana
tgaccaaattctagaagtgacttgataacatgagaggctataaagctggttcctccggtaaccaagtactctgccattttattaggctcctctgattttgtgtaacattgacaaactagatcatgcgattagatggtctaattttattttattttgtgttagaaggatgttcaatcctggttgatttagtttatgtttgacttttttttatgtagtctttgaataatagtagttacatctaactttcataaagacttggattagtataacctaattataagctttgggcttgaagcaaatataatgaactgaatgtgggcttttaaagtatccaaagaggtttatgaaatgtgatatattttttttggtcttcaatctcttgaaaattggttagcaatccattggcagttgaaggctctctcagagaccttgactagaaggcctcaaaggcaaaggaaggtggaaggaaaaatcaaaattcccggagctgaaagttgacacaaaggaatcaacctagttctttcttgtcttagcttttttgaagggaaatgaaaattgacacaaaagaaggtggaaggaaaaatatgatgcttgtcctttattggacatatcattttgcagaatatatattcttcctagcattttgcatgcattgtgtctaggttgtcatgttgtggctggtttactaagttcctagtacaatgaacaaagcgccagagctgaaagttgaaataacaatcgtcaacatcccaaccgccttaacattaaaaccaaccaaaaaaacaaaaacacatcccaaccgaaagcagcaatccaggaagattagtttatgtaaatgacaaacataaatatgaaaccgtcacatagttgagagtcgccgtgaatatttactttttaaataaaaagatatggttagccgctggttggtctgacaccccatgtatcattatactcattatccgtatgaaggaccattttttcatataaggatatacacgtttgtaacgtatgcagagccaacaccaagtatataacttgtactgtcgtctctgattctgttaaagcggttaactagattattgactatgataattcaatgtaacaccaatttatgccccggacaaaaaaaaaatggtgaaaccaaaatatttgatttgcatcccagttactatttccctgcaatgatatgggggcggcggtttggagatatcgccaatgccacaatttgtcgtaaaaacagttaaacattttactcactagtcactccccacaaaaaaaacgatacttagttccactctctactactacaaaacttgtatacattaaaaaacgatttttattgagtagacattaatgatcggcttataagtctaaacaagtaatgtgacagaattcacgtgaacaaatgctcgagtgggatgtttttattgcttctcaagttggtgatctttaatatcgccaagattaggttgtgcattaaatttggattactttttataaattaaatcaagatatggatatgataaactttctctcttttcttttagttaacatactttatagactttatactacattagattaattgcagatttaaacaatgtttaaaattacaaaaacgttaaatgtcatattttccatataaattttgttttacgtaaaagcaatttacatgaattttgataaaatcatgaaaaaacagaagcggtgtccaagattggggatgaatgagaaaacaccgcactgatagtaactgaaaagaatgtaaccagtctcacgatggggatggcggagagaaagagagagacaagacagtagagaaaagaaggtacgacggagagatgaaggttggacagagagaacaaaacgagaacggcaatggccgggaaaaaaggagagtagggaggaaaaaaaaaagaattttgtttttttagcttttgtagggttttttgttagtcgtaaaatataaattataatatcaaagaaaataatgagttaattttaaagaaggttagatgatatttttcacaagtttttgttgatatagtaaacccacaattttattttgtcattcaaagtaaattttcaacaaaatatagctgttgctggtcacattttaacgggaaaaaataattcttgtacctggatgtataacctctgaaccttgtattacaaatttacaaaacacattgatctcaatcagaccgaacatgtatatcgagtcaactgacaaatctcttttcctactcttgttacatattctttctaggaaaaaaaaatgctttcaggctcaatgaaatgaattaaaacagcaaaaggttggtaaaagtctttttccccataatcatttgctccataattgacgtttgtctggcaacaactggaaacacagatatagaaaaaaagattggacagtaaatcataaaaaaaaaaaagcaaaattaaatagaaagacgaagcgagagaaagagcgttgagtggcgtgagagtttgagtccgaaaattaactcctctcccatctgccaactttcctctgtttctcctttatatcccaaacctattcttcctccacacctcatcataggcatagcaaaactcttccaaa

SEQ ID NO: 81 - DNA, 2500 bp, Arabidopsis thaliana
tgaccaaattctagaagtgacttgataacatgagaggctataaagctggttcctccggtaaccaagtactctgccattttattaggctcctctgattttgtgtaacattgacaaactagatcatgcgattagatggtctaattttattttattttgtgttagaaggatgttcaatcctggttgatttagtttatgtttgacttttttttatgtagtctttgaataatagtagttacatctaactttcataaagacttggattagtataacctaattataagctttgggcttgaagcaaatataatgaactgaatgtgggcttttaaagtatccaaagaggtttatgaaatgtgatatattttttttggtcttcaatctcttgaaaattggttagcaatccattggcagttgaaggctctctcagagaccttgactagaaggcctcaaaggcaaaggaaggtggaaggaaaaatcaaaattcccggagctgaaagttgacacaaaggaatcaacctagttctttcttgtcttagcttttttgaagggaaatgaaaattgacacaaaagaaggtggaaggaaaaatatgatgcttgtcctttattggacatatcattttgcagaatatatattcttcctagcattttgcatgcattgtgtctaggttgtcatgttgtggctggtttactaagttcctagtacaatgaacaaagcgccagagctgaaagttgaaataacaatcgtcaacatcccaaccgccttaacattaaaaccaaccaaaaaaacaaaaacacatcccaaccgaaagcagcaatccaggaagattagtttatgtaaatgacaaacataaatatgaaaccgtcacatagttgagagtcgccgtgaatatttactttttaaataaaaagatatggttagccgctggttggtctgacaccccatgtatcattatactcattatccgtatgaaggaccattttttcatataaggatatacacgtttgtaacgtatgcagagccaacaccaagtatataacttgtactgtcgtctctgattctgttaaagcggttaactagattattgactatgataattcaatgtaacaccaatttatgccccggacaaaaaaaaaatggtgaaaccaaaatatttgatttgcatcccagttactatttccctgcaatgatatgggggcggcggtttggagatatcgccaatgccacaatttgtcgtaaaaacagttaaacattttactcactagtcactccccacaaaaaaaacgatacttagttccactctctactactacaaaacttgtatacattaaaaaacgatttttattgagtagacattaatgatcggcttataagtctaaacaagtaatgtgacagaattcacgtgaacaaatgctcgagtgggatgtttttattgcttctcaagttggtgatctttaatatcgccaagattaggttgtgcattaaatttggattactttttataaattaaatcaagatatggatatgataaactttctctcttttcttttagttaacatactttatagactttatactacattagattaattgcagatttaaacaatgtttaaaattacaaaaacgttaaatgtcatattttccatataaattttgttttacgtaaaagcaatttacatgaattttgataaaatcatgaaaaaacagaagcggtgtccaagattggggatgaatgagaaaacaccgcactgatagtaactgaaaagaatgtaaccagtctcacgatggggatggcggagagaaagagagagacaagacagtagagaaaagaaggtacgacggagagatgaaggttggacagagagaacaaaacgagaacggcaatggccgggaaaaaaggagagtagggaggaaaaaaaaaagaattttgtttttttagcttttgtagggttttttgttagtcgtaaaatataaattataatatcaaagaaaataatgagttaattttaaagaaggttagatgatatttttcacaagtttttgttgatatagtaaacccacaattttattttgtcattcaaagtaaattttcaacaaaatatagctgttgctggtcacattttaacgggaaaaaataattcttgtacctggatgtataacctctgaaccttgtattacaaatttacaaaacacattgatctcaatcagaccgaacatgtatatcgagtcaactgacaaatctcttttcctactcttgttacatattctttctaggaaaaaaaaatgctttcaggctcaatgaaatgaattaaaacagcaaaaggttggtaaaagtctttttccccataatcatttgctccataattgacgtttgtctggcaacaactggaaacacagatatagaaaaaaagattggacagtaaatcataaaaaaaaaaaagcaaaattaaatagaaagacgaagcgagagaaagagcgttgagtggcgtgagagtttgagtccga

SEQ ID NO: 82 - DNA, 3455 bp, Glycine max
gagtatttattgagagaatacttgcgagattctttttaatatgttatttactaattattattatttaaaatttattagaaatattttttaaatctcatttcttctattaattttaatcaataaaaaagaaaaaatatattaaaaagtatgctacatatctcatttgttaaaataagagtttattaacttaggagagttttcataagttcacaatttaatttgattctgaataaaaaaaaaagcttatagaatatttgtataactaattaagtctaaataaattttacataaattgtttcaaaccctctaatatatgcactagctcctaactatcttttattatatttaattgcaattttaatgaaatcctcttttgtttcagaagcttatagaataattattttcatttaataaatggtttttatgattctgatgtaatattttaattattttctctctctctctctctctctccctatatatatatatatatatatatatatatatatatatatatatatatatatatatatatatatatatatatattctcctaacaaacctttaaggatttatccaccgctgcatatgccaggctgaaaaacaattatttcattttcgtgggtgtatatataaaaaaaacttgtggaataagagaggtgttgatcgatgagctgtaataaccttcaatcttgagcttcaaacaaactcaagttatggtcttccctatagctagctaatattttttggtgttgatagctagctaatattttggactgcactgtttacactcaacagttcaatttacaccaacttaaccaacaaatcttccttcgattttctgctgcccattgaaactctgcatgtcaaaatgctacttgtcacaaataaaaaaggttgagaaaaaggataataagggaataacaacaatatatacaacatgagcatccgtttactatacgctgcttaatgtcatgcacagtacttatctaagcaaatttttttgacaagatgtgaatgatgtaacaataaacatttcatctctttctataatatatacttagttaggttattatattcgtacaatcagcttctgtatcattttatttccactctcttttttatcttgttttttttcatttctcatcatatttaccaattttttgataaaaaataaccatatttaccgatttttctctctttaatttatttttattttttttatccctctatgtttatctttcttgcacagttgcacttgtaaataatacccttataacttttttcctatatactttcgcaattataatacgcggtttgtctgtccgttgactgttgctatatgtagtatatagcagtacttatttatttattttatcagtacagtacttatttatttcagtgtacgaaagcggttgtttttattttcagatttaaatttgaattcaacctcgtcataatccccaatccaagaacaaagacaaaatttagaagggtacggagaacttaaagtctcacaaatccttttttaattccggatatccacaaattaaccggaagtaggactaattcctgaaaatattaaaatgtatttagtttagggaattaattttttctataaatatttttaatttaatacatatagatgtcgaaattatattaaacctctaattacaaacatataatgatattgagatatacatgattgatcaggagttaaaaatataaaaacaaaaaaagtgaatgaagaaaaaaaaaagaaaataaattgtgagtttaaatttttccagtgatattttaaaaaaataataataaattaatatttatcgtcgataatattagtatctcttactccccttgctctataggctcgaacttattatgattgatggttgtcattcatatgttccactaataaaaggagtaagattgacaaatgaataactagttaaggtgagtgcattaaatcagtaagatacaatactcgttataaattattaaatgaacgaatagtcaatgcttgactgttgacaacctttgaatagtcaatgttatctatttatccttagatggactttggcaacattgatgttaatccagagtggaatgtaaagttttaacgcatagcatgtctaaaatgatatgtatgtagtgtagaatctttatatgtgttatttttttttataaagatgaataatcaataataaagtttatgactgttttccattgatgttatgataaaattaaataaataaatccaaggcaatcacttcaaagacgttataattagacaatatcagcttcttcttctttttttctaaaaatgataaggataaataagtatgaattaatcataacagcacatctttttgtactaaaagatgattcattttaaaaaggtaagcattacgttacgaataaatttgttttcatgatattttgtttgtatgcaacatatttttcaatacaaaaatatttttatataattcaaactaaacataattttaaaattattttttagctaacacaataaaatttatataattaatttaaaaaataattgtgaacaaaataaatcagtaaataattttttcattataagatagcctaaaattattttttataagatttgtgtaaaaataatatataataaaagaaaatatgttaaaaactgagcaatgctattgggtacaaatagcataaacacaaaaccaaacgactagaaacgtgacttaatattatttttaaaaaatatatatattaattaacttttttcataaatataaaataggttttggtagaaatcacagttgatgcaaaaccaattcgtacaagacagcattttcctttaaaaaaattgtgtatatttgcctcagccacacgaaagcctaattaataagttatctcattttggaagtacgttgtatctacatgtgaacgtatttaaatgtaactaaatccatgtttaatgaaactttcggcgttgatctgacacatggttttattttaattttttttcgtttggatccatgagattgaggtgtgggtgcactttttttggtttgtgttttattatcattgttataagatcacacagacgcacgtacggagaggagagatatagaagtagttgcaattgcaaagaaggccgtgtcccaatttccctttgaaagcacaaatttaatgatgaaaggaagagaagaaataaaagtatgtttacgggtgttagggtttagttagatgtggaaggggtggagttatgaaaattaataccaagttaagtgagcgttgagtgacgtgaagtcttacattaatacctctcatctgccccgttcagaccttagggtcccttggcctttaaaacctcaccacccctacactgagttattatcattcaagcaccattcttctcgatcttctctttctcaaccgaaccaaattacagatttaacaag

SEQ ID NO: 83 - DNA, 3000 bp, Glycine max
gagtatttattgagagaatacttgcgagattctttttaatatgttatttactaattattattatttaaaatttattagaaatattttttaaatctcatttcttctattaattttaatcaataaaaaagaaaaaatatattaaaaagtatgctacatatctcatttgttaaaataagagtttattaacttaggagagttttcataagttcacaatttaatttgattctgaataaaaaaaaaagcttatagaatatttgtataactaattaagtctaaataaattttacataaattgtttcaaaccctctaatatatgcactagctcctaactatcttttattatatttaattgcaattttaatgaaatcctcttttgtttcagaagcttatagaataattattttcatttaataaatggtttttatgattctgatgtaatattttaattattttctctctctctctctctctctccctatatatatatatatatatatatatatatatatatatatatatatatatatatatatatatatatatatatattctcctaacaaacctttaaggatttatccaccgctgcatatgccaggctgaaaaacaattatttcattttcgtgggtgtatatataaaaaaaacttgtggaataagagaggtgttgatcgatgagctgtaataaccttcaatcttgagcttcaaacaaactcaagttatggtcttccctatagctagctaatattttttggtgttgatagctagctaatattttggactgcactgtttacactcaacagttcaatttacaccaacttaaccaacaaatcttccttcgattttctgctgcccattgaaactctgcatgtcaaaatgctacttgtcacaaataaaaaaggttgagaaaaaggataataagggaataacaacaatatatacaacatgagcatccgtttactatacgctgcttaatgtcatgcacagtacttatctaagcaaatttttttgacaagatgtgaatgatgtaacaataaacatttcatctctttctataatatatacttagttaggttattatattcgtacaatcagcttctgtatcattttatttccactctcttttttatcttgttttttttcatttctcatcatatttaccaattttttgataaaaaataaccatatttaccgatttttctctctttaatttatttttattttttttatccctctatgtttatctttcttgcacagttgcacttgtaaataatacccttataacttttttcctatatactttcgcaattataatacgcggtttgtctgtccgttgactgttgctatatgtagtatatagcagtacttatttatttattttatcagtacagtacttatttatttcagtgtacgaaagcggttgtttttattttcagatttaaatttgaattcaacctcgtcataatccccaatccaagaacaaagacaaaatttagaagggtacggagaacttaaagtctcacaaatccttttttaattccggatatccacaaattaaccggaagtaggactaattcctgaaaatattaaaatgtatttagtttagggaattaattttttctataaatatttttaatttaatacatatagatgtcgaaattatattaaacctctaattacaaacatataatgatattgagatatacatgattgatcaggagttaaaaatataaaaacaaaaaaagtgaatgaagaaaaaaaaaagaaaataaattgtgagtttaaatttttccagtgatattttaaaaaaataataataaattaatatttatcgtcgataatattagtatctcttactccccttgctctataggctcgaacttattatgattgatggttgtcattcatatgttccactaataaaaggagtaagattgacaaatgaataactagttaaggtgagtgcattaaatcagtaagatacaatactcgttataaattattaaatgaacgaatagtcaatgcttgactgttgacaacctttgaatagtcaatgttatctatttatccttagatggactttggcaacattgatgttaatccagagtggaatgtaaagttttaacgcatagcatgtctaaaatgatatgtatgtagtgtagaatctttatatgtgttatttttttttataaagatgaataatcaataataaagtttatgactgttttccattgatgttatgataaaattaaataaataaatccaaggcaatcacttcaaagacgttataattagacaatatcagcttcttcttctttttttctaaaaatgataaggataaataagtatgaattaatcataacagcacatctttttgtactaaaagatgattcattttaaaaaggtaagcattacgttacgaataaatttgttttcatgatattttgtttgtatgcaacatatttttcaatacaaaaatatttttatataattcaaactaaacataattttaaaattattttttagctaacacaataaaatttatataattaatttaaaaaataattgtgaacaaaataaatcagtaaataattttttcattataagatagcctaaaattattttttataagatttgtgtaaaaataatatataataaaagaaaatatgttaaaaactgagcaatgctattgggtacaaatagcataaacacaaaaccaaacgactagaaacgtgacttaatattatttttaaaaaatatatatattaattaacttttttcataaatataaaataggttttggtagaaatcacagttgatgcaaaaccaattcgtacaagacagcattttcctttaaaaaaattgtgtatatttgcctcagccacacgaaagcctaattaataagttatctcattttggaagtacgttgtatctacatgtgaacgtatttaaatgtaactaaatccatgtttaatgaaactttcggcgttgatctgacacatggt

SEQ ID NO: 84 - DNA, 3138 bp, Populus trichocarpa
aaaaaggaaattaactaatattatatatatagtgaattcttaaaaatacgtccctcaatatgataaacattgttatatcgatcgggaaatatagttttagtgttcctagtatttttaaaaagaggtgccttcgtccaactaatcaaaatacgagagtcaaactatgagagttacatataatttggtgtcagagtagaatggcatgaagttatggctgctaaactttagctgactgtctgtttcatagcctaatttagccaacacctcaagttcctctctcctgatggcatctgctgctatctctatcctcatagcttttaacccatatcacatgttttcaaggtaccagagaggcggtggcttgatctaagaaatttaatcttaccggtaatttgcaatttatttgcatagttgatttcaattaatattgatgtcatactataaccggacttactaaatatattaccagggtctaaaatgcataccaccatcaccaggaccggaattaagggccggctcctgcaatgaaattttttccagtatttttcatttaataaattagatttttagttttaaaaataaaaaataattttttttaatttgaccagctcaaaataaaattaatagcttcgccccttatcctcacctcgacatttgtctttgtaccagttaccaaagacatcacggcaggattcgaggctggtgaagagagaagattaaagaaaggtgtacctcaaggagggacgatgagtaaattaaatatatttattttggaatttttaaattcatgagcacacgaggcgcgacggctcttattaaatttttcgtacttaccatggagaaaaaaaaaacaaataaagtaataaatgtataagcgagacgtacctttttggttcctgcactacaactgtttttgaagcacaaaatattattttttttcctttcaacgtaaaacaccaattcctttaaaaggaaacaacttttcttcgaatataaaacaggggtttaaagcaacgcaactcgttgagattctttcaagtttgtgcagtgcagctcatgatggtagtcataacacaacagtcctggatccaactacatttataattaagttctctctttggttgaccagtgagaatcattgagaaatatcaaaacgagtttttaaaaaaatgaatatgaaaacaaatgctccgctttgacttttctttacttttccctgctttaatggataggggtatcaatttgtccagttgcagttgtggaagtaaaatacaattatgtaacattttagttgttttttaaaatgtttttaatttaaaaatatattaaaatattttttattttaaaaaaattatttttaatactaacatattacaaccagatacaaacatgaaaaatattcttaaacaattctttttaattttttaataaaatattatttgaaatacaatactgtaacattttagttgaaactctattttctctacaaggatgcatggatacttttttttttaactaattgagtgtataacagtaattataattttttaaaatattttttatttgaaaatatattaaaataatattttttattttttaataaattatctttgacatcattatattaaaacgatttaaaaaaataaaatttaataaatcagtgtttgaaatgcgtttaaatatctctttggcgcggtcagccatagctttccatgcattaaactacaggcgaggacatcagacgccagttgttatataatttttggacataaggtgacaaatcttaatttccccaccacatgcagtactattcttctttcctttcgatcttgtgctaattaactagtcacatgttttgcttaattaaattgaagtgtcaatttcattttcatgttaaattaatttgttgtcggttctatatataacaaaattatcccttctgtttgtaagtattgaattttttacaagatttatttatttaaatacaaattacttttatttgaaatcttttaattatatatattcctttgttattgaacatgaatccaacatagattcatgggaattaggtccacgagaatatattagcccctagctataaacgactgagaagatacattttactaacccccctctcctctagtggatgcgatcaggttcaagtaaaactgattacagtgatacaatttcaaatgcttctggatctttctcccctttcactcataattaatttttctaatccctcctttttcttattataaaatgtatatgtcatcaaatttgaaaatatgcatataccaaacatcattaaaaataactattttattttgtaatcattcctttgttgattttttagctcaaaacaaacaaattctaaacgtgattactacgattcaacttcaatacagatgttacttgaaattctgctagattacttaattaatagtttctagctaaattatccatatatatctcttgatttataatttctgattaataaaaacagtgatcatttgatttggagcacacaataacaaatatgctattgatgagtgaaaaaaaatagccgagagaaatataaacaaagttattaaatttggttctatttagaactccactagagattcaagtcaatcaaaaaaatgttattttaatttaataaaaataaaactaaattttaatcagttcattaattaattcattgaattactcatttgattagttgcaatctcaccaagttttttttttaaaatccgacacagcaataacaaaggatattggacagggaagggtactccgaacccgtacctggtaggatgtctagttacacccggagagaaaagaaaagaaaaggccagaaaaaattaatagatatattttttttttttggtgtaagaaaattaatagagttaagtgggcgttgagcgcctcattaatcttctcatctgcctccatcattgcccacggccccgtgcctttatatctcccatcctcccgcctccccccctcacctaatatcatcaactctctttctctcaagcaacaaccatacactcatctcttctcgtctccctctctctccccctcagtacactacattcctcaacatttcttcttcttcttcttcttggcaaaata

SEQ ID NO: 85 - DNA, 3000 bp, Populus trichocarpa
aaaaaggaaattaactaatattatatatatagtgaattcttaaaaatacgtccctcaatatgataaacattgttatatcgatcgggaaatatagttttagtgttcctagtatttttaaaaagaggtgccttcgtccaactaatcaaaatacgagagtcaaactatgagagttacatataatttggtgtcagagtagaatggcatgaagttatggctgctaaactttagctgactgtctgtttcatagcctaatttagccaacacctcaagttcctctctcctgatggcatctgctgctatctctatcctcatagcttttaacccatatcacatgttttcaaggtaccagagaggcggtggcttgatctaagaaatttaatcttaccggtaatttgcaatttatttgcatagttgatttcaattaatattgatgtcatactataaccggacttactaaatatattaccagggtctaaaatgcataccaccatcaccaggaccggaattaagggccggctcctgcaatgaaattttttccagtatttttcatttaataaattagatttttagttttaaaaataaaaaataattttttttaatttgaccagctcaaaataaaattaatagcttcgccccttatcctcacctcgacatttgtctttgtaccagttaccaaagacatcacggcaggattcgaggctggtgaagagagaagattaaagaaaggtgtacctcaaggagggacgatgagtaaattaaatatatttattttggaatttttaaattcatgagcacacgaggcgcgacggctcttattaaatttttcgtacttaccatggagaaaaaaaaaacaaataaagtaataaatgtataagcgagacgtacctttttggttcctgcactacaactgtttttgaagcacaaaatattattttttttcctttcaacgtaaaacaccaattcctttaaaaggaaacaacttttcttcgaatataaaacaggggtttaaagcaacgcaactcgttgagattctttcaagtttgtgcagtgcagctcatgatggtagtcataacacaacagtcctggatccaactacatttataattaagttctctctttggttgaccagtgagaatcattgagaaatatcaaaacgagtttttaaaaaaatgaatatgaaaacaaatgctccgctttgacttttctttacttttccctgctttaatggataggggtatcaatttgtccagttgcagttgtggaagtaaaatacaattatgtaacattttagttgttttttaaaatgtttttaatttaaaaatatattaaaatattttttattttaaaaaaattatttttaatactaacatattacaaccagatacaaacatgaaaaatattcttaaacaattctttttaattttttaataaaatattatttgaaatacaatactgtaacattttagttgaaactctattttctctacaaggatgcatggatacttttttttttaactaattgagtgtataacagtaattataattttttaaaatattttttatttgaaaatatattaaaataatattttttattttttaataaattatctttgacatcattatattaaaacgatttaaaaaaataaaatttaataaatcagtgtttgaaatgcgtttaaatatctctttggcgcggtcagccatagctttccatgcattaaactacaggcgaggacatcagacgccagttgttatataatttttggacataaggtgacaaatcttaatttccccaccacatgcagtactattcttctttcctttcgatcttgtgctaattaactagtcacatgttttgcttaattaaattgaagtgtcaatttcattttcatgttaaattaatttgttgtcggttctatatataacaaaattatcccttctgtttgtaagtattgaattttttacaagatttatttatttaaatacaaattacttttatttgaaatcttttaattatatatattcctttgttattgaacatgaatccaacatagattcatgggaattaggtccacgagaatatattagcccctagctataaacgactgagaagatacattttactaacccccctctcctctagtggatgcgatcaggttcaagtaaaactgattacagtgatacaatttcaaatgcttctggatctttctcccctttcactcataattaatttttctaatccctcctttttcttattataaaatgtatatgtcatcaaatttgaaaatatgcatataccaaacatcattaaaaataactattttattttgtaatcattcctttgttgattttttagctcaaaacaaacaaattctaaacgtgattactacgattcaacttcaatacagatgttacttgaaattctgctagattacttaattaatagtttctagctaaattatccatatatatctcttgatttataatttctgattaataaaaacagtgatcatttgatttggagcacacaataacaaatatgctattgatgagtgaaaaaaaatagccgagagaaatataaacaaagttattaaatttggttctatttagaactccactagagattcaagtcaatcaaaaaaatgttattttaatttaataaaaataaaactaaattttaatcagttcattaattaattcattgaattactcatttgattagttgcaatctcaccaagttttttttttaaaatccgacacagcaataacaaaggatattggacagggaagggtactccgaacccgtacctggtaggatgtctagttacacccggagagaaaagaaaagaaaaggccagaaaaaattaatagatatattttttttttttggtgtaagaaaattaatagagttaagtgggcgttgagcgcctcattaatcttctcatctgcctccatcattgcccacggccccgtgcctttatatctcccatcctcccgcct

SEQ ID NO: 86 - DNA, 2556 bp, Vitus vinifera
tttttaaaataattatttcaaaaaatatcaacagtgcaattattttttataataaaatttaacatatcatataaaaagctttctttttttaataaaaaattattaattagaaaattattttctgttttgaaattaaaaaaaataaaaaataaaaaaattccagaagagttttgaaacaggaccacatgttaaaggtaggtgcttaaattaaaaattgaatatgatatcgacggtggcagcaggtggagtctgagtgtgagtggggatggccgttggccacataaaattctcagagagttaggtttggttcccatgaaatgaaagtggcctttccatttaacattctacaaggtgtctccatttgcctttgccaccattaaatttagggtttctgggttcatcttctgtccatttcagatgaatgcactctcctctctcccccgtatatcccctctgcacttccatcttaaatgccatattttgtggttcaaaacttgacccccattcatactccaccttcatgtcttgatgctttcttatttttgcactccaaaagaagggaaaaaagagagaagtatgaaacaaaaacgaggcataacatgatcacttcattatataattacccatcaaatatatatttactaaaattacaaatgtcaataacaaaatattagatcgataactgttttcaaaaacagtttttgaaaatagtctttaaaaattattatttcatgtttttataaaataaaattttatttaaaaacttaaaatgtttttaacttgtttttagtatctttaaatatattttaaaaataatttttatatgcctttgtcatttcattttgatgttaatttttatatttgaaaattgttttaattattaattttaatttaatgaaagctcagcccaatctaaaccagcaagatggttgatgatagataataattaataatatataccccaaatcagaataaatctgctagccgttaccctcaaatatttgaagtatccctatacattttggtgatgcaacttgttgtgttgattaggtttttagtatacatggtttaagagaaacaatccttaattagtttatactaaatgatgttatagacactaagtccaccttatgttagaagtactagttttagattagcttaactcaaatgttttatttcaaaagattagagtatgattaagaatgttttttgaaaaactattttataaaatagtttttttaaatagaattttatttgagaatttgaaatatactccgacttgtttttatgtatttttaaatattttttaaaattaatttttatttattatgctttatttttcatcattttttgtatttgtattgttaaaacaatttctagaacaagtaaaaataattaaaatatgtcatttaaaatcattatattttcacaataagttttccaaatattatttttattaaaaaataaaaataataattttttgctcgtaagtacatttgtttttgtgttttttttttcttcaaagaactctttatcatagtatcatgtaagaggtatcattacgttttttttccaagcactcaatgctaacaataccaaaatgtttactaaaaatgtaattttatttgttttttgttttaaaaaatagaaaattattttaaaaagtaattacaaaaaacctatttgacaactatttttaaaaacaattctgaaacttatttttgtataacaaaactctataatatttttaatattcttatatatgttttaaaaataatttttatatctagtatttaaaacaattctaaaaataataataaaaaaaaattaaaattttttttattttttgcttttaataataaaaaacaaaaaataatttttaatggtttagtttgtttttattatgaataatagaaaattattttaaaaaccaattctcagtacaaaatggcccggaatgttcggattgcgttgtacaaaacccatgatacaatcactttctagtttgtagaggtgggatgaggctattaattgcttgggagtgtcattgaaaggatggatcttggcttatgaaatttcaccactttggaagaaaaacaatgaactgatgaattaatttaagtcccaaatcaattaattaaggatgaatattttgaatttacaaggaagggtgctatttttttattagaccaaagtagaaaaatgaacaaataacagtaacccattaaagaggggcatcatgaatatgaaaatgaaaatgaaagagaaaaagagaaacaaggggggagtttagttgattaataatgagggaggttaggaaataaagtgtaggtgagtccaggtgggggagcgttgcgtgagtgtgagctgttcattaaatcctctcatctgccctctatttaattcccactattttagctttgcctttaaatcccacctcaccctcccattttctccctaccactctcttttctctcttctttcatcaacatcatcagctctttctctttctctctttctgtctttctccctcaattcttaattctcactcccaaa

SEQ ID NO: 87 - DNA, 2500 bp, Vitus vinifera
tttttaaaataattatttcaaaaaatatcaacagtgcaattattttttataataaaatttaacatatcatataaaaagctttctttttttaataaaaaattattaattagaaaattattttctgttttgaaattaaaaaaaataaaaaataaaaaaattccagaagagttttgaaacaggaccacatgttaaaggtaggtgcttaaattaaaaattgaatatgatatcgacggtggcagcaggtggagtctgagtgtgagtggggatggccgttggccacataaaattctcagagagttaggtttggttcccatgaaatgaaagtggcctttccatttaacattctacaaggtgtctccatttgcctttgccaccattaaatttagggtttctgggttcatcttctgtccatttcagatgaatgcactctcctctctcccccgtatatcccctctgcacttccatcttaaatgccatattttgtggttcaaaacttgacccccattcatactccaccttcatgtcttgatgctttcttatttttgcactccaaaagaagggaaaaaagagagaagtatgaaacaaaaacgaggcataacatgatcacttcattatataattacccatcaaatatatatttactaaaattacaaatgtcaataacaaaatattagatcgataactgttttcaaaaacagtttttgaaaatagtctttaaaaattattatttcatgtttttataaaataaaattttatttaaaaacttaaaatgtttttaacttgtttttagtatctttaaatatattttaaaaataatttttatatgcctttgtcatttcattttgatgttaatttttatatttgaaaattgttttaattattaattttaatttaatgaaagctcagcccaatctaaaccagcaagatggttgatgatagataataattaataatatataccccaaatcagaataaatctgctagccgttaccctcaaatatttgaagtatccctatacattttggtgatgcaacttgttgtgttgattaggtttttagtatacatggtttaagagaaacaatccttaattagtttatactaaatgatgttatagacactaagtccaccttatgttagaagtactagttttagattagcttaactcaaatgttttatttcaaaagattagagtatgattaagaatgttttttgaaaaactattttataaaatagtttttttaaatagaattttatttgagaatttgaaatatactccgacttgtttttatgtatttttaaatattttttaaaattaatttttatttattatgctttatttttcatcattttttgtatttgtattgttaaaacaatttctagaacaagtaaaaataattaaaatatgtcatttaaaatcattatattttcacaataagttttccaaatattatttttattaaaaaataaaaataataattttttgctcgtaagtacatttgtttttgtgttttttttttcttcaaagaactctttatcatagtatcatgtaagaggtatcattacgttttttttccaagcactcaatgctaacaataccaaaatgtttactaaaaatgtaattttatttgttttttgttttaaaaaatagaaaattattttaaaaagtaattacaaaaaacctatttgacaactatttttaaaaacaattctgaaacttatttttgtataacaaaactctataatatttttaatattcttatatatgttttaaaaataatttttatatctagtatttaaaacaattctaaaaataataataaaaaaaaattaaaattttttttattttttgcttttaataataaaaaacaaaaaataatttttaatggtttagtttgtttttattatgaataatagaaaattattttaaaaaccaattctcagtacaaaatggcccggaatgttcggattgcgttgtacaaaacccatgatacaatcactttctagtttgtagaggtgggatgaggctattaattgcttgggagtgtcattgaaaggatggatcttggcttatgaaatttcaccactttggaagaaaaacaatgaactgatgaattaatttaagtcccaaatcaattaattaaggatgaatattttgaatttacaaggaagggtgctatttttttattagaccaaagtagaaaaatgaacaaataacagtaacccattaaagaggggcatcatgaatatgaaaatgaaaatgaaagagaaaaagagaaacaaggggggagtttagttgattaataatgagggaggttaggaaataaagtgtaggtgagtccaggtgggggagcgttgcgtgagtgtgagctgttcattaaatcctctcatctgccctctatttaattcccactattttagctttgcctttaaatcccacctcaccctcccattttctccctaccactctcttttctctcttctttcatcaacatcatcagct

SEQ ID NO: 88 - DNA, 3000 bp, Sorghum bicolor
tatccccttgatgacgacgagcgttgagcgtgcgtggcagtgattgtctgattgactgatcgagcaagtgtgtatagtagccaactctctctgcatgtggtggcttgcaggacgcacacaactattatagaggccggccgcgcatatatataggtatataggatcagtcaatcagacaatcactaaagatacattgacatgtttgtgtttttcctagaaaatcatttcaaaattttcaaaggaaagccttttaagacaaactagaagttatttattttgatctatatgtatttttactcctacataagaggctacctttatcttccacataaaattttagaagataactttgacatcatggacaagttcgaatagacccatgacggctaatgtgtgatgtgagtctcaccttgggtcttgagagttggttagaccaacatactcccttcatcctaatctataagtcactctaagaatcttgtcaaaacatctcaagtaactaacattatagaaaaaatcaaaaagatttatgacatcaaataaatattactataaaaatataactaatgaagaatctaatgatacttagatgatatcataaatgttattatgttatcatataaatttggtcaaacttaagatacttttgactttctaagattcttggaatgacttataatttaggatggaaggagtatacggcttctagagtccttatcatcaacaccatgctagaccttttacgtgaggggaggatgaaagcataagtgggttgataggactgtggttcgcttagtgtatggtgtgaacccgatagactctagaaacttgtgtatcaatggtcaattatgagtagaaggttccatcggaacaattattatttatttcaagctatttcggctctttcttaatcttcaaaaagaaattaattccgtaatggtaagacgaaaaaagaaaaaaaaataaaaaggaagtgtggaaaaatgacaaaatggcggcacagggaggcgagaaccaccgcttttaggaaataagcctacaatttgattctcgtctcgttttacttgcattttctttcgttcagtctcgttctgagagtggaatcgaaccactcactccgtttggatttagagtccaaagggcccagccagcgaaagaggattgacctccgtggacatgtggtgcatggtacgtgttggcccaatcaatgtagcttgtgacatggcactgcgccattactagatgcatgcacgtgtgtttcaagagggaacattttttgtgaaatgtggttgtattcacatcaatccatgtgtattagggtggattgaagtggaagttgaactaaattttacctcaatccaccgcaacccatgtggattgaggcgaatccaacaacattcaaataaggccttacttggttatgggtgtgttggggagacgttgacatgaggccctttgagatggttgcaacctgggtcaatttaacttaggccatggtggatcatgtgtatgttgaggtgagatcgtgcaggtttggtctcaccttgatcactgagggtggatatagcacatataatgtttttaatctacatcattaactctaggttggcccttttatgtaaagcaaggatgaaagcataaataggttagtgaaagtgtgcgcttaactaagagtgtagagtggatctgagatattgaactctaagcactaaataaccaagttttaacttatgtcaatgttaatttgttagtataaacaataagaatataataagcatataaatattgtaatacaacttaccaccaataactttagtactctactgcaaagtataaagacgttttggcttttctagatatatagtttggttgtgcacttacatatattttatgtctagatatatacatattagaatgtatctagaaaagacaaactatcttacaatttagagtgaagagagtatatatagagatgtaatgatcatcttgcatcattgaaatactatatgacatcaaattattacaaaaacaaaaatatcattggttgaagcttgttgaagatcataaattattatttttgagccctcataaggtacaactgccgtttctaaacatatgcacaaacacaaacactcacgcacgcatacaacacacacccagtgtgcacgacctacaaactatacacacgtagatacgaaccatgttacggtcgacgcggacatgaactgggccttcatgaggggcagcactagatatcactgagtgatctcactgagtccaccccttccccctcctcctgatggcatccttggaccggaaaccatgtcagggctctccgatctttgcttcaaccatggcgtcaagtttgaagcactcgtctcacagcgttttggatgcccagtgagtcccatctctccccagactgttttggatctttgcttcaaccatggcgtcaagttttggatctctccccagcattttggatgcccggtccgctgtccgtctgaatattgattcagtgagtctcatccttcaagcttgctttggtggcaaagaatacaatgttacccatctctctggatggatgttcaaattttcaatatcttgcaaaaatgtggctttcatgattaacaaccttaaaagccactctttcaaaacttttctcatcttctttcacctttggagtggaggaggaccaaattggcgcaaggattttactctctggcaacaggagcaagatgcaaaatggaaccttgttggatccaagtccaagaaatcttatgctgatattgctaaatcaaatatcaaaaaatcagttttgttgcgcttatcttaccccaccaattatgcatccaacttcctggagccccctcgcagagcatctttggctcctgacaggttctcccatcgccctgctcaaaataatgtgatgaaagcacaaattgatagtaaacctgtcaaaggtttgcaacaatctcatcctagtggctttccaagatg

SEQ ID NO: 89 - DNA, 3070 bp, Zea mays
cgggcggagcggagttcgccgtcttccggggcctagcccaagtccgagccctgggtcgggcggaacggagttcgccgtcttccggggcttagcccgagtccgagccctgggtcgggcggagcggagttcgccgtcttccggggcttagcccgagtccgagccctgggtcgggcggaacgaagttcgccgtcttccggggcttagcccgagtccgagccctgagtcgggcggagcggagtttcctatggcgcctttggcaaggcctgactgcctgtcagactcactctgtcgagtggcactgcagtcggagtggcgcaggcggcgctgtccttctgtcagaccggtcagtggagcagcgaagtgacggcggtcacttcggctctgccggggggcgcgcgtcaggataaaggtgtcaggccacctttgcgttaaatgctcctgcgactcggtcggtcggtgcggcgatttagtcatggttgcttctcagcgaaggcaaggcctcgggcgagccggagatatgtccgccgttaaaggggggtctcgggcgagacggaaatctctcggggtcggctgcccttgtccgaggctaggctcgggcgaggcgtgatcaagtcgctcgtatggactgatccctgacttaatcgcacccatcaggcctctgcagctttatgctgatgggggttaccagctgagaattaggcgtcttgagggtacccctaattatggtccccgacaataagtatcactgagattattaaattatatttttggattgagggagtagtatttaaagaagagccttgcatgcaatttcttttgtttgaataatgttttcaacttaaatacttttttttgcatgtgtaacatttattctccataatatttttccatgtatctaacttataaatcattttcataaaccaatgtcaaagatgaatccatgtttcttacttggaaaccccgaacaaacaccactagcacgaggcgctcgcgttagcgtcgctcaccgacgacgagaagaaacttggcgactgtcagttcgaactctggaagcagtcctacatggcccatgcgccgctgtgtacggcaagctccggcgcagctgccgcttggacgtggtccagagcggctgcaccgcgctgtccatcgtcaaacatggggacctcatggtcgtcgccaatgtcgacgactctcgggttgttctgggcatcgcaacctacgacgacgccatcacgccgtctagctcatcatccacctgaagcctaacctgccacgtaagtcgctactgaccgaccatgaattcttgtgcgctggaatgatgaccattgttgttgttgtgtgagtgtcctcgaacaagatgtatgtagaggagtagcacatccggtggtgcaacgaccaggtgtactacctcgctgatgagcccggggtgcacttcatttggcagcccagccaagagtgatcggtactcaccatatcgcgcgcgttcgacgactattatatcaaggattgtggcgtcatctcgacaccggaggtgagcagaggtggaccgacaacaatgaccactcgccatcgtcggggtaccttttgtgtcggcctgcctttaattctcttcgcaaacacacacttgtattttttgtttaagcaagcgtgtatggtggtgcgtgcctgatgactaacgatgtacgacggaacttctaccggcaggtgtggcacgtgctctccaataatgagaccatgcaaatcatgacatatatcgaagtgtgcatgatactgatagttgcaatgtagtagtgaaacaactaaattaaaataacaaaatttatgtatggctaggatcacaaatgaattatgaaatattttcttataacaatataagacacattttgtatataagttatcatggtattatatgttcccgttgcaacgcacgggtactgacctattgttcattaaggatctttaatagatgttttttgttattttctcgaacctaaatgttcgtcgaccaaacttgttttgtatcagtgtataatattattgtcactgttttttatgtcgcggactatgttttttgtacgtcattgaaactacctataaaattgtcactgtgtatcagcgtatgtgtatgcagttggcttgatgtgagacaataagctgaacccacggggttttcatggttttccacccaattacgagttggtttgcggtcaataatattattggatgggttgggtttattttttttcttatattttagggtgggtgtgggataaatatcaaagttattatacttgggtatgaatgggagtgagttggattttttgccattagcaggcctacatggcggcaaacacacccccatgtctttatccccatttcatacaagtcaggtaattaacgagtatccgctgacatgagactgttttgagttttgacgctttcataccggcctgatgatgataccttggcagttggcaaacggcccatcgatgtccgccattaactgccgatccaatccaagtaaccgtaggtatctttctgaccatagtccacaagtccaaaccagccgtcaaaccaaccgatcatggacatccgatgggcatgcttgttgcgcgatcaaaagtcatcatacaaaaaatgtgatgaataaaaactggacaaaatttgtgccatcgaatggagcatacagtcgtggggggcctgctacaagaccaggcgccaaccccctgcctctgggctctggttggtggcggtagccgggctctcatttaaactacccatctgcccccgattcttttaattacgggcgaccctcgcggctccgcccctattttaagaccccaccacggcaccacctcctccgcaaacaacacacgaacaccgcaccgcaacgtagccggctaggggaagagctctttccttcagctgtgccgtgcacaacgcacggcacgctggtttggtttgcatcgcccccgccaagacgctgccgtgagcaggcagagcgggtgggaagactggtgggcgagccggccgcgccgagggatagcagcagcagcagcaggcgggcgac

SEQ ID NO: 90 - DNA, 2719 bp, Setaria italica
aaagcaaagattcatgcctgagctgttggtgacgctatcagctttggctcacctaaaagcagcgccggccacagctggggttcgtttcgtctactctgattctcttctgaagtctgaagtccaaaccatggccaaagtgactgttgacgcaggcacgtaaatattcaattgtcacagtgcggtttggacaccacgtagacaaacgtttcctggtcctgagcttttgattggcccatttcagactagtacgttaatgcttgcactggcccgaagcggaccacattgctactgtgtgtttatctgctccgagaaattgggagatagggtggttagtacagatgagcagctgttcgctttctccatctatcattcttcagcacctgcacttccaaaaagctttgaatttggcttaggtcatggaacggcttttgtcaggatctcaacgttctcctttatttgcgagctcaactccttcctcatagctaactcttcgttcagtcctccagcattgccctctgaagtctgaaccactccatttctatattgtacaaggaaaaggagtgctatatcagggttgcatttccaaatctgcaaagcacgcgtacttgaagccatcaaaagatgactggccagcaggagcagcttgccagtgacacagatttcgtccaaacggagcacgcagcgcatcgtgctacagcgaatcgatcggatcgagctgaggccaagcattcaaggttttgcaggtgcattgtgatgccgacccgacacacgcgactgctgcagtggctccatctataaatctgtcctatataccagcacgcgtgaacagacaaaaaaaaacatcaacaacaagaagagaagttttactgctgcttccagaaaccagcctgatcatgagtttttggctttgagaacgagctgaggatggttttccagggcaggtgaacgacatctcgccatttctcaatcctctaacctctccagatgaggggaaacagttcagtgctttgcctgtgcattgtgcgagaatcgggcgggagcgttcatcttgatccagcacagcagggctttaattgtgcaagcagaaggtaccagtaccagcagaggattgatttgcacatgtggaagctctgaagccgttgctatcgcatcgttctgacccggtttggtggcacgagcaaggtagccaaatcaggccagccattgcatgtgttgccgtacatgcacaagaaagtttaaccgcagtcatatgaagtactactgacccggatgtactacatgactgcagactgtgatgcttgctagaggtaaaaggacacggagggcaggagtcctgccagttccctcaatgctctgtgctccgatctctctagaagggacccccttctttttatttttgaaactatagaaagacaaatttcccttccccttattagattgtactaagtactattttgattacttgtttttatgaattgtgcagaggctgagaggcctgatccaactttgggtgcggccacaatgtgtgggaaatatgcgctgtgttcatctgcacctctctgccccctttatctcaagcaaacgtctgtaccttgattatgtacttggtatgattggtgtgagattcagatgcaacgattacttcatatgagccttgctcatcaccgattttccctcccttctctcgtgcctttttccttttcccaaaccactgaagctcaaccagtccgcatcagttcactactcccgctagcatggcaacggcatgatcatgaaggattccaacaaatggcctggcagctgatggaattcgactgctctctctgaaatttagctactccttttttcatcaattgagttttgacgataacaatttggagtggcgcaattcacaaccacaaccaacacttgtctccctctccctggacggaacagtgcggccttgctaatgctaccaacaacacggtgcgcggtcgtacccttggccgttggcaaatggccgatcgacatcgccattaactgccggtccaagctgcgccaggcaagccgcgaaagccgtagagtaccttcccgttcctgcccaccaacggcttcctccgcgcaccgggacgacaacctgatcgacccatccccaccacttgatcgtcgcacaccgatcctcgcgtgcgctacagttcgtcacgcacccgtacgttcaaccgtcgtctcctcacccctcgctaaatcctcgctgttttcccgaaattgcttaccaaaaccccgtgcgcgcgcgtgcccgaagctgcagtgctgcaggcggatgcgagcgccggagcaccggagccggaggcaggcaggcccccgcccccagtggccaacccctaactcctccggttggtggcggtagccgggctctcatttaaactacccatctgccccggatttaattacgggcgccccctttcccggctcgcccactatattaagaccccaccacggcaccacgtctcctccgcaaacaaacaccccaactcgccaggccaacgtacccccacacaaaacaccgcgacgcagcgccccggttctccctagcttcccactgcgcccaacgcacggcacgcggttgcagcagcgtccgcgagttccctgcggagagcagaggccagaggcgagcggcagggagggagagtgatcgatcgactagtgaagtgagccgcgccgcgcgagggcggggggcgcc

SEQ ID NO: 91 - DNA, 2500 bp, Setaria italica
aaagcaaagattcatgcctgagctgttggtgacgctatcagctttggctcacctaaaagcagcgccggccacagctggggttcgtttcgtctactctgattctcttctgaagtctgaagtccaaaccatggccaaagtgactgttgacgcaggcacgtaaatattcaattgtcacagtgcggtttggacaccacgtagacaaacgtttcctggtcctgagcttttgattggcccatttcagactagtacgttaatgcttgcactggcccgaagcggaccacattgctactgtgtgtttatctgctccgagaaattgggagatagggtggttagtacagatgagcagctgttcgctttctccatctatcattcttcagcacctgcacttccaaaaagctttgaatttggcttaggtcatggaacggcttttgtcaggatctcaacgttctcctttatttgcgagctcaactccttcctcatagctaactcttcgttcagtcctccagcattgccctctgaagtctgaaccactccatttctatattgtacaaggaaaaggagtgctatatcagggttgcatttccaaatctgcaaagcacgcgtacttgaagccatcaaaagatgactggccagcaggagcagcttgccagtgacacagatttcgtccaaacggagcacgcagcgcatcgtgctacagcgaatcgatcggatcgagctgaggccaagcattcaaggttttgcaggtgcattgtgatgccgacccgacacacgcgactgctgcagtggctccatctataaatctgtcctatataccagcacgcgtgaacagacaaaaaaaaacatcaacaacaagaagagaagttttactgctgcttccagaaaccagcctgatcatgagtttttggctttgagaacgagctgaggatggttttccagggcaggtgaacgacatctcgccatttctcaatcctctaacctctccagatgaggggaaacagttcagtgctttgcctgtgcattgtgcgagaatcgggcgggagcgttcatcttgatccagcacagcagggctttaattgtgcaagcagaaggtaccagtaccagcagaggattgatttgcacatgtggaagctctgaagccgttgctatcgcatcgttctgacccggtttggtggcacgagcaaggtagccaaatcaggccagccattgcatgtgttgccgtacatgcacaagaaagtttaaccgcagtcatatgaagtactactgacccggatgtactacatgactgcagactgtgatgcttgctagaggtaaaaggacacggagggcaggagtcctgccagttccctcaatgctctgtgctccgatctctctagaagggacccccttctttttatttttgaaactatagaaagacaaatttcccttccccttattagattgtactaagtactattttgattacttgtttttatgaattgtgcagaggctgagaggcctgatccaactttgggtgcggccacaatgtgtgggaaatatgcgctgtgttcatctgcacctctctgccccctttatctcaagcaaacgtctgtaccttgattatgtacttggtatgattggtgtgagattcagatgcaacgattacttcatatgagccttgctcatcaccgattttccctcccttctctcgtgcctttttccttttcccaaaccactgaagctcaaccagtccgcatcagttcactactcccgctagcatggcaacggcatgatcatgaaggattccaacaaatggcctggcagctgatggaattcgactgctctctctgaaatttagctactccttttttcatcaattgagttttgacgataacaatttggagtggcgcaattcacaaccacaaccaacacttgtctccctctccctggacggaacagtgcggccttgctaatgctaccaacaacacggtgcgcggtcgtacccttggccgttggcaaatggccgatcgacatcgccattaactgccggtccaagctgcgccaggcaagccgcgaaagccgtagagtaccttcccgttcctgcccaccaacggcttcctccgcgcaccgggacgacaacctgatcgacccatccccaccacttgatcgtcgcacaccgatcctcgcgtgcgctacagttcgtcacgcacccgtacgttcaaccgtcgtctcctcacccctcgctaaatcctcgctgttttcccgaaattgcttaccaaaaccccgtgcgcgcgcgtgcccgaagctgcagtgctgcaggcggatgcgagcgccggagcaccggagccggaggcaggcaggcccccgcccccagtggccaacccctaactcctccggttggtggcggtagccgggctctcatttaaactacccatctgccccggatttaattacgggcgccccctttcccggctcgcccactatattaagaccccaccacggcaccacgtctcctccgcaaaca

SEQ ID NO: 92 - DNA, 2754 bp, Oryza sativa
ggcaggatgtactcacgtacagttagagcattaacttaggcaagcgtttttctttgcaggtaatggcctctgtcaaacctaatacagattggcagtttggcgcgatggacaggtcatgatcaattttaaataagcagatgatcacatttaatgtgtagtatgaagggaacaggtagaataatacttgtaagtttacaatcctgtcccacgaagatgtcgatcccctaagtgccgttcgtcgtagtacatgagggacaggtccaaaacgaagagacggaattcgctcgtgcgaaacaagggcaagagagacgtgaaccgaacaggattgcccttgcacacctgcggcggatgtatggttgcagctaagctttattaatgtgagtctctgcccttcctctggtcgatcgatgacgagcaaacacagcgcgtttcgccacgctttctcccaacccccaactccatcccatgtcggcccatcgtccattcgtcctccagaccgatcacatattcagacccgtcaacttcagcatttcacgcggccactacgacagctgcttcggctgcactttcactcgtatcagcgcgaggggaagaagaacaatccgtggttttccgtttcttcagaggcatggacagatcgtctcacgactcgtacgcgaagatgcttgatgcttcccggaggatcctgtctcgaattttgattggatcactgcgcactggacactcactactacgttaatgctgctgccagggctgcagccaaaggaccacactgtcattggctccgggacaataggaggccatatatttagccattttttagggagattttcaccaattgtacagttgcactattgctacgcagatcactgcatacgcaattaactctttcttacaagctcagaagctgtctgcacctatatagctactccctcctccgttctataaaaaaccaacctactatcggatgtgacacatcctaatactatgaatctggatatacatcatactaaaatatgttatatccggttctagattcgtttttatggaacggagggagtattctgtcatcagctatcactgctctgcctgaacttgtctgagctattactactgtagtatatgaatttatgaagtggagtctcgtaacaaaaatacgagtatactccgtactgtactacccttatcaggattcaaggatactaggagtatagcattaccagatcaggcacttagatgtggccatccaaagagtaatggtaatagcctaataggagtaccatctactattgatctttcaaaaaaaaaagtactagtatagaagtagtatccagctagagctgcttaacagggtcagaatttgtccaaacagagcttgtaatgcacactgacgaagtcgatccgatcgaatcagagtcaacatttaaagagtactatttcgaagtaaaactgttcagttcttacaagattacatgtgaatttgcaagacttggacatgagtgttcatctcgtagtttaatgatgggtacccaacctgcaacaacagtgctttaaattgtacaagcagagggtaccaacagagtaatttgcacatgcagtcctgaacctgatgccattgcgaaacacacaaccctatacggtgcagatgcaagggagcccaattcagtcccagccattatctgtattgccgtacttccgcagggaaagttaccctctcatctgatctaccattgcatacatctcaaaaggaagtgagtaaaaaagaaaacaggaccaatcttcagagataagtttttgaaacctatcttcagagataagttcactcggcgataggagaggacctgatttggactcaaatcaggtgttgacgaatagagtagcaagagttttttcgacgggtcaagacctcaagggtcttaacagttgaactaactcggttatgatttggacacttggtgattaactactgataatagtactacttattgttattggcttgttacatcattcggtgctcaaaaatcagatgcaaatttagatgggacagacagcagctactagcaacataagagaattatgttcagtgtatcatgcatgactaaactctgaacgtactcacctggatccagatgcgagcagtacagtacctgtgcacattgcttgtgtattactccacttaattacgaactctattattttcctccgataatgcccgcagaacaaggttgtcactgaaaaatggtcctctccagagtccaggagctataggaggagtatgatactccttagcaatcatatactcatatgacatatccaaattgacaccggggttaagccgttaaccgtcactacgagttgcacttgtataaacaaaaaacaagggagaaaaccttgtgtcccccccatgatgcagaaatctaataagagcagcccaacgcttccggttggtggcggtagaccggcctctttaaactaccccatccgccccagatttatcaattactcctcgtcatctcgtctcgtctccgccaccgtgcgcgcgtcccctatattagaccccccaaccgggcaccggacacaccatcaccaacacaccactgcaaacccatccgcctccgcaccgcatcgcacctacaaattgtgcacgctgcaccgctcaaaaaaaagaagaaactaaagtcgtacgtaggacgcggcgtgcgagcgttggtgcggtgcgcggcggcgcgcggggaagtagtgagagcatcgatc

SEQ ID NO: 93 - DNA, 2500 bp, Oryza sativa
ggcaggatgtactcacgtacagttagagcattaacttaggcaagcgtttttctttgcaggtaatggcctctgtcaaacctaatacagattggcagtttggcgcgatggacaggtcatgatcaattttaaataagcagatgatcacatttaatgtgtagtatgaagggaacaggtagaataatacttgtaagtttacaatcctgtcccacgaagatgtcgatcccctaagtgccgttcgtcgtagtacatgagggacaggtccaaaacgaagagacggaattcgctcgtgcgaaacaagggcaagagagacgtgaaccgaacaggattgcccttgcacacctgcggcggatgtatggttgcagctaagctttattaatgtgagtctctgcccttcctctggtcgatcgatgacgagcaaacacagcgcgtttcgccacgctttctcccaacccccaactccatcccatgtcggcccatcgtccattcgtcctccagaccgatcacatattcagacccgtcaacttcagcatttcacgcggccactacgacagctgcttcggctgcactttcactcgtatcagcgcgaggggaagaagaacaatccgtggttttccgtttcttcagaggcatggacagatcgtctcacgactcgtacgcgaagatgcttgatgcttcccggaggatcctgtctcgaattttgattggatcactgcgcactggacactcactactacgttaatgctgctgccagggctgcagccaaaggaccacactgtcattggctccgggacaataggaggccatatatttagccattttttagggagattttcaccaattgtacagttgcactattgctacgcagatcactgcatacgcaattaactctttcttacaagctcagaagctgtctgcacctatatagctactccctcctccgttctataaaaaaccaacctactatcggatgtgacacatcctaatactatgaatctggatatacatcatactaaaatatgttatatccggttctagattcgtttttatggaacggagggagtattctgtcatcagctatcactgctctgcctgaacttgtctgagctattactactgtagtatatgaatttatgaagtggagtctcgtaacaaaaatacgagtatactccgtactgtactacccttatcaggattcaaggatactaggagtatagcattaccagatcaggcacttagatgtggccatccaaagagtaatggtaatagcctaataggagtaccatctactattgatctttcaaaaaaaaaagtactagtatagaagtagtatccagctagagctgcttaacagggtcagaatttgtccaaacagagcttgtaatgcacactgacgaagtcgatccgatcgaatcagagtcaacatttaaagagtactatttcgaagtaaaactgttcagttcttacaagattacatgtgaatttgcaagacttggacatgagtgttcatctcgtagtttaatgatgggtacccaacctgcaacaacagtgctttaaattgtacaagcagagggtaccaacagagtaatttgcacatgcagtcctgaacctgatgccattgcgaaacacacaaccctatacggtgcagatgcaagggagcccaattcagtcccagccattatctgtattgccgtacttccgcagggaaagttaccctctcatctgatctaccattgcatacatctcaaaaggaagtgagtaaaaaagaaaacaggaccaatcttcagagataagtttttgaaacctatcttcagagataagttcactcggcgataggagaggacctgatttggactcaaatcaggtgttgacgaatagagtagcaagagttttttcgacgggtcaagacctcaagggtcttaacagttgaactaactcggttatgatttggacacttggtgattaactactgataatagtactacttattgttattggcttgttacatcattcggtgctcaaaaatcagatgcaaatttagatgggacagacagcagctactagcaacataagagaattatgttcagtgtatcatgcatgactaaactctgaacgtactcacctggatccagatgcgagcagtacagtacctgtgcacattgcttgtgtattactccacttaattacgaactctattattttcctccgataatgcccgcagaacaaggttgtcactgaaaaatggtcctctccagagtccaggagctataggaggagtatgatactccttagcaatcatatactcatatgacatatccaaattgacaccggggttaagccgttaaccgtcactacgagttgcacttgtataaacaaaaaacaagggagaaaaccttgtgtcccccccatgatgcagaaatctaataagagcagcccaacgcttccggttggtggcggtagaccggcctctttaaactaccccatccgccccagatttatcaat

SEQ ID NO: 94 - DNA, 2000 bp, Glycine max
tttaaatttgttgcagaatgatcataattaaatttccaaggcaataaaaatccctgtctacaaatttatttccataggggctttggatcgatggcgtggaccccacctgaaagtgacacccttggatctcacgggtttcagtgtcaaacctcatttaataagtcaccccatctcccacccttaatttccaccatccaattctccaatctccttcttcataaattaacggctgtgatctatttgaccctactactactttatgaccattctccattcggttacaaatcaatatttctctcactcccaaattaaaaaattgccaattaccaaacatgccatctctcaaaaagtacaaagtgttactattatttctatttaattagtatagtagtactctttctaataaatttaatattaaaatcacataattgtacgtactacttagtaattgagattcttcaaaataaagagaataactctcaggtaatttagtgaattctgaaagacaataaattgtgtttttgacaaatgttaatacaacaattttatacagtagtaatattttttatatcacaaaaactaaatataatttcatctgaataatctatttattttttaatgtaaatatttatcacttagattatcaagattacgatttttaaagaaaagattaacaagattacgaattgggttaagccaatttgtataagaaaattggatatcatatgcccatgaggtcttgggtcctgtccacaaggaaatttaactcatttttactctatatatacttctaacgtcatatattgcaacaataatatatgcgttactttgacgaaatttctactaacgttggcattgaagttgcttttagaagtacctatcaattttccacgatatttcagtcacattgaaacaacagttgaattcagaaaaaaaaaattaaaaaaattgaacttcaaatacttcacagtccaccttaaacatatcattcacattcatctaagataaaaatcaatcactaattttaattagataatagtattaatagaaacattaaaagccttatctttttataaagctgtttttcattttcatcacatccagcatcgatctcaatccaaactctttcttttcacaccctatgagtaactcaaacctgacatcatccaacacggcgcgtgtatcccactctcttccttggaagacgtaaggaggcaggaagcgcgtgggagaggaactgagaggaaaaaaaggtttgactttggtgaagggtgtgggaaacgtttagaatggccattaagaaagcaccacgtggagcgtaacagccgacgtagtaagtattgctgatcggtttctgtcaacccgcatttaccatttacagtaaatttattaaattaaattaaattaacccatttattacaacacactatgaattgaatgaatgaatatgagcattatatgaagagagagaggaacgtagaaaagaaaactaggataaggtaaaggactaaggagaaaaagaaagagaaagagagaaagggactctgtccccttttgtgtgcgtgtgttttgtcaactgagtgaactctcaagtgaactaacatcaccaaaaaaaccactctcttgcaacctcctcatcacattgctccttctggtattccatataacttattaactttgatttttttctctctttaattttttcttttcttccgatcatgtaacatgctaaaaaataatttgtaagattctggttggttggttttgtagggaatctttttctcttgtttttttctgggttgaatgagaataatgttttgatagtttaaagctttttatttgtttggtttctgatatgggaaagttttgttgtggggtgttagagacaggtttggctcaactgaagtaaggtttggttatcttattaccttatctctcaccacatttaaaaacacacaaaacacagttacacaagtgaagtgtggttttgggaagcaaga

SEQ ID NO: 95 - DNA, 2000 bp, Glycine max
atgaattattatatatgctctatttgttaaattttttaaaataattattttaaaagttatacatagatttttttattggttaatagtataaaattttaactctcacaaaacaccatgcacgaaaattaaactcatgaacaatataaatatacttttttatctgaaataaacgagggaaaatatctcttatttgagaaaaaaaatttaaaaatatttttgttactactatgtcataagttaatatcttggaagtttaaagaatattaacttgttaaaataattcaatattttttttgtctgtaatgtgttagccagtattaacacaattaatttgtttttggtaataacaatgcttagatatggcaagaaaactcatacttgtgggtatccgtctgaattcgtttcgactttgacgggtaatacctgagttgacctggtataggttcgggtttggatttttctcgataatcaaaagtcagatacgggtatgggtatgaggttactagactcgtcccgaccccaaacccgaactcgccctgccacttaaaatctttaaatttttttgcataatttaatcaaaaggcataaaatttttattactagttaattttattttagaatttttacataatttaatattattttcttaactatttttgtagacacatgcgctataataaatttattaatatataagtagttaaaacaaatgtttaacaattaactttctttttctaaaatcaaacttttaatattttttttataaaaaaaaatatttttttaatttaaatcgtgtatgggacagggtcggggataccggataggtacaggaatgagaaaataaatttaaacccgatatcgaatacgaatatgaagatatattgagaagttagaataagagattgagagacaatactcataaccatcccactctccattgcaatgtctaacaatgcttacacatgcacaagcaatgactcagctcaggtaacattcatacattctattaacatgttggcgtcacaagcattattataatacacccaatttttcctattaaatgaaaaagacgacgtaccgtatgcccctccaattaaacacaaccgacatggagaaaatgatgatggttgattgcctacgaaaggtgacaattcgtgaaaacaatgatgatatatgcttgctaaaagagaaataccaataaaatgtttacacattatttattattaactgaacattatataaattgtaaagagtttaataaatatatattgttaagttgaaagtttttgcagcattgttgcttgcacttcttgtgcaacaattctgaccttatttatacattatcaatcaattgaaaatatacagtttattatagatgatgattttaaaatttaacaaatttattataaataatgatttattagacaatggtgtaaaaaacttttatattttactaaaaacatgtttttttaaaatgtatgatgctattattcacgtttctcattttttaacagtcggttgaagacttttagtttagctgcttcacactaccaaggccattccttccccactttgaacaattcacatttttattattttttgcagtacccatatttttcaagtgacagcctactaatcattcaaaggtgtaaaaaattgaatttttattgctatccagcaaccacttttttgtttttttttttgtacaaaatatatagataccatatgtgacatgcctataataaattaataactgaaggctgataaaataaaaggttaataactgaaggtagttttatctacttgtctctacgtcaagaagcacgtgaacacaactgaaaggtgccaacaaaacatgttggaaggttagctacataatcttcggtggagcaaatattccacttgtgcacatgcatgcatatataattggttatttgcaatgcctcattccatgcactgaaactagttgcgacacttgtattgcagtgcacataataacc

SEQ ID NO: 96 - DNA, 2000 bp, Glycine max
acttcgatgttcttgcacttgttatagaattcatgtcataataagtgtgtgctcgaagtaaaaattaattttaattgttttttctatttatacttctaacattagcaatttgcataacaaacaagatttaatacaagattaattttgtaaaattgttactttttttatttattcttgctagaaaaagagaaagaacctttcacgaaaatcttcataatttcatttgaggttcacatatatctttggaagtggaggactacgatgcaacagtttatttattatttcagagaataaccattacccaaaatttctttgaccggagtagcttgtccatgaaataagacatggtggtaataaaaaaaaggattaattgaacattattgtcatggaatagtaaacatacataaattaaatgactcttcatgtctttttttcttcttcatcatgatattcataggaaataatcctcatttgactaattagttgggtcaccaggtgtaccaatagttattggtctttttctttttgagtaacaaataccattgaaaagtcatttaatttattatttgtatgtataatggtagatgatctggaggttattattatatctttttcgggtttgtgttaagtttatttatttttcttaataaatgattcattacaaaaggatttttttaagtgtatatttcttcttttttttctacttcttctttcaagggcaggaaaatctcatatattgtggtccttccttcaccactcccatgtggatggttcacgggttcataattactcacgcttacttagccaacatttagatatgactctatctaaatttttttgtttacttcaacatttctcacttgtcctacttttgttatcgaataatttttggatattaaatggaccttcccagaagttaattttaatgtggccaatttcttctcttttgtaattagctcttagacaataataataatgatatttctagattatctccatttattttcctattcatacgtgattctgttgtgcgattgaatgttagatagacggtgtagatgaggtgcaaaattttaattcagtctgacatgtttaattgtgaagaaaatgttgaaaaaaattaaaataaaagaaaagaaataaatgagaagagaatgcaaagtcttgaattaaataaaaaaatattaatagcaaaataattttaattaacaccacatgactatatcatacaataaatataaggaaaaaataaataagaaaaataattatttagcctgggttgaagcactagttgattttgaccgtgtgtagcaaaatgatccctctcctaagatacgacaaccagttggtttcgaccgacgtgtgcagcaaaagaatcccgaaacttgtgaacactaatgcttttgctctaaaaaataagtttttataggaaaagaaaaagaagatatttgggagaaaggagttatgtgcttgtgttgttcttttttagagaacaagaaatatatatatatatagagagagagagagagatagatcaccttgtgcagcaaacaaaaatatgatcattgtattcaacctatagttattaaaacaaacgtaatagaccagttgactcattaaaataaaatcttaagaaaatttaaaataaatattttattttataaaataaaattaatatatatttataaattttaaattaaaacacagatacttatcgatagaaaatagtaatagtgtgtaggatattaatgaaaggtgaaaggcttttttgttcacccccaagacttgttgatgttgagtcgttggtaacaatacacaccacctaacaccatcacgtgctcaccttcaatttacaatactcgaacgaaacgatttgttagattaagtaactgaaagattaatgttattatttaagaagcttctctcctgagggaggattaaaaaactgtctataaagtaagtttcattttatcctttgaagtgtgtgagagagtgaaaac

SEQ ID NO: 97 - DNA, 2000 bp, Glycine max
acatagccccaaaaccactattgaatatcaattagaaattggaagggttacttaaccttccattaaacatacaagtttccccatgataatagggatcaaaaataatgatcagggattcattccaaagaaaagtttacaaaatcaattttcgctcattttataggagttaaacccatttttaagccaaaaacctttacgtataaacaacattttaaaagttatttttcaataaaagcatcttttagagtttactgtttttatggcatattcaccccagtacagtttatattgctttcgtttaaacaggagttcatgaatttctaaaaaaaatgtttatgatacttgtcatttcgattgttcatatggtgcctgtcagataattaatgtctccgtggtgtttaactgttaagtagttgattttttgtcatgtaatcttgtaaatgacaattctatcgttaatcaaacaatccgtatacacacacacacacggagaaactagtgtgggtttgaccaaggaccctgaattcttcttctttgtataaggtcaggcaagtggtagagttcgaatagtaagttttgaagtttaaagcttgtacacaaaatatatatatatatatattgataaagaatggatataattgttttacaacgtgcagcgagggaacccttcaatacgcacctctctaccaagtctaacttaaaaacacagaattatcaaacacccaatttatgtgttagaatgtcttgcttttcgctactactattgtctggtgggcatgatgattttctcacaaaataattggaatattccacttatctctggctgatcttttttcttacatttaagacaatagagagtattaaatttgttataatcgtaatatttatatattaaatagtatttatggtatatttaaatatatatatatatagaatattattttatatatgcatattatagttattgttaattcagcatgtgttctggtttctgaaataaaataaaaaaacaaaaatttgaaaaatagaaactagaataaaaaaaatcaataaaaaggacctcacttattattttgactgttactaattacggaaataagttacttaaatgtattaaattaatttttgaaaattaatgcattaaagaaacttatttaatgtattaaataagtatttaatgcatttcaggaaaaagcatttaatgtattaaatacagtttagaaattaatttttgtttcattttttatttataaaattatgttttctttttacatatttgtaaaattatttggagagatgaaaaaaaatgtgtaaaaagaaagagtctaccaacaagtagttagtccaaatagtattgaattcaaattttttaaataaagttttgttaaaattaattatgaataaaattgatagataattctaacataattacacaaaaaaatctttaatcataatactccctttagacctcaaatgtaaaaaaaataaaaaaaaaatcaattgtgttagattaaaatataaacaaattttaattaactatcacctactttatcacctacttaatgatgtattttcaaaacatcattcgtttaattgagttttatttttaataatcttatttttttttcttatataatcaatatagatgatattttaaggaataaattaactttttattgaaattatcaaaattaaataatattaactaattttttgtctaatggttgagtccagagagagtaatatttgtgggtggagttttactggtggatgtggacaggtgtgagccacatgttaccatgcagtgagtcagaaaaaagaagtggcaggatatccggcgggttcacggcttggaagttgcaataaatattaaatgaggatgcagatattcttcttctgtcggtggtatgatatatatatatatataaggccgggcagaaaggaaaggaaatactattacatagcagaagcaaagaaaatactattactagctaatgagt

SEQ ID NO: 98 - DNA, 3138 bp, Sorghum bicolor
tgccacgacgacggagtacataccgtagactgccagtagtacatttactttaaccatcagtaaaatgtagcctggttgttgagaaactgtagtacatgaaagttggacttcagccgtagcttcgcatatataaacactgtttcaccgggagatcgatgtaggagtacgaaccaagtacgtacgagtatgcagttgataatgaactaatgcaccccatgataatcacgccacattgatctaaattaggatgaacatgttgatgtttcctcttaacctggttaattagacggcgaacgagtaagattttatttggagtcctatgtactccctgattccatttggagaaatgaggccaaggttttgctatcaacatcgaggtaagttagaaaacatgcaaaattaacttataaagaacaaaataaaagaaaagaaaggcagaattatgaccatatttacccgtttgagccacacctgttaccacttaatgaaaaacgcgctgttgcgtggtctcaaaaaaaaattggagttgtttagacaatactttctctatgctaaattataagacgctataattttttaaatgtatagttttgcaatgtacttagatagataagcaataatgtaactagtagagaagatatataaatatcttacaatttcaaaccgacaaatatattcctgaacgctggctgtagttagcagtcgcaaccaataatccagagacaacggtgcatgtgtgtgtcaatattgcagcaaccggatgtctggaacacgtcacgatgcctcaacgaaccagatcaagatggatcacgacgcgtgccaaactcctttacgcctagctggaccctttagcagaaatgggatgaacggttgcaacaacgttggatgagcagtgtacttcaggagccaattaaggagaaaatcattaattttgccggcgagcactatgtatgtgcgccccccccccccaccccccacacacacacacacatcctttacgagtaggactactacaggtatggttaatttgtacgtttcagtaaccgatttttgcgggtccagttggagacagaacgatcgaggaaggttttgccttttgggacagctcacaggtggctccgcggtgacctaggaaatgaattcacttagagcaagtacttcctccatctcaaattgtaagtcattccaacaatcttggagagtcaaacttttctaagtttgaccaaatttatattataaaataattattattatagtactaactaagtatcattagattctttgttaattatatttttatagtatactcactttacgttataaattttagtatttttctctataattttggtcaaacgtgaaaatgttttgactctctaaaattcttggaatgacttacaatttggaatggagggagtacaataaaatcacgttacttgacttagacatatcagcaaaattctagtggaaaaaagagaggagggagaaaagctgcttagcttggcgcaacatgtaacgtcgagtgcccaagtggtgtgtgtctcgctactgtcctttcaactacctcgcgggacacaacagctgagtgagcttaggttaagctaccatgttgtcattgctgttcacgtcatcctcgccgtcctccagcctcacgcggcgcctgctgtcatggtcgcgtccgcgtgtgctcgcctccgctgctcaccagtactgtgagctcaccatgggttcgcccatgcgcgctaataggatgggttgttcgtcgacgcgaacaaaagtgtggtgatgacgaagagaaaaggatagtcattggtggcccacataataaaaaaaaacacattgagaacagtaaaaatcatattattattatatgacttgtttttatgttagtctatcagtgatatggcttgacttaggtcactcacaatgcaagactctatcacagagtctaagacaattaattatacattatttatggtattttgctgatgtggcagcatatttattgaagaaagaggtagaaaaaataagactccaaatcttatttagactctaagtccacattgttcgaggtaataaatgactttagactctatgatagagtctgcattgtgaaggcactcacaatgtaagactctatcacagagttcaagacacttaattatatattatttatggtattttgctgatgtggcagcatatttattgaaaaaaaaggtagaaaaaataagactccaagtcttatttagactctaagtccacattgttcgaggtaataaataactttagactctatgataaagtctgcattgagtggcccgagtgctcttatagctaaatttactaggcttgttcttaggactttcgaaattactgccccgcgcacacgtcaccatgcttgaaaagttgaattaaaagtactcaccgtgttattatttactcaactattaattggaaaaaggcacgctggagctcagcgctagcagctgactgccataagaccatgtttggcaggttccgtaccggcctgagactctgtttagttttcaatttaaacttctcatctcattatatatacccaatgtttggacacatacctggagcattagatatagaatgtgttatagtacctaaaaacaaatgtgttatagtacctaaaaacatttttttcctttttgtaaactaaacaaggtttaagaatcatataagaaactcgactaaaatgattggaatctggaaataaaaactgatccatcgtttctgtttttttttttaaactctggaagcaagaatcaactgaatcctactgtagcttctagtttcccaagaaacgtttcttgattattatactaagtagggacataaacaactgaaaccctgggttagtgggaaaagggagccacagcacctgtccctttattagtagtaattaatataagcaactgtgccatttttgcatctggtcctatataaatagagacgtggaggcgtccaagacgcattcgaggcgacagacatcgtcgtcccagcaaagcacaggctctctccccggtcacccctctcgctcacgagtcacgagcatcccacctcagctagctagctccagcagctctctatcttcccgaccagggcttggac

SEQ ID NO: 99 - DNA, 3191 bp, Oryza sativa
gaacctactgccgtgttgtgctgtggtgctgcatgcctgctggcgatgagtgctgctgactgcttgctccatgctggatgccgctggtctgctgcggcgctgcgcgcttcctgcctgcccgcggctgccgccgtcacacgttcgtgcctcactgccttagttgtcgtcgctgactcattcactcgcgcgatcgaaaattgggaatgacaattgcgatggaaacgaaaggacgcggtgcttgttgcagcgaaaaaacgaagcaaaacagttgccaacttgccattgatatttttctagaagtaacgcataggggtgatgggccttgggctagatttctatggtggtccatggaccacagtgtaactccgctcctgtgcttaactcttattcttatttttaaagaaaatccgctttacaactttaatttagatggatgaacgagaacggataatgcgcccgataaattagggatatcttcttttgtggttttcttttttttttgccggttcggcggaagaaacaccgaccaaattttattaagattgaaagaagttacatgcatccgacattagaccgtcgagttaaggcgagaagacctaagaagcaaaacaaaagaaaaactgagagaagaatgtaaagggcaagtgcacttagggctactcctcactaaaccttcttttgtggattgatgcatcaaaaaactatatgtactaggttacatcgtgttttttttttcgttttcgtctcattctctgcttcggcctgccgtctgcttataccgttaattcgatgatgactccagacttcattcatgaatatatttctactatagatatacaaccctcgctcctctatgtttatcttcatcttcatcttcaggagattcaaacaccacctcttaaagatgaagatgaagatgaagataaaaattaagtgtttcacgtaaaacgatgtattaataacatgtgattaatagagttttaattgttataaacttgaaaaatgaattagtatgatattttagagcaactttcatatataaagttttcgcacgagacgtaccgtttagcagtttgaaaagcatgtcacgagtatccaaaatttaatcttgtgcttgcagaagaaacgaagagggcctaacccatataacctgcgtcattaatctatagcttagcaaagtttacttttttgcctgcctcctggcacaggaacgccgacgaagaaaaacctacaggctttctcaactatgattccttcctcaacctgtgaactctggcgacaggaggacgacaggggtgtatgtggagcagataatgcacagtaataatccaatccttaggacttacaaactgctggaatgaactgaccaagtacgtttagaacgtaggaattttgacttatacatgcatagtgtgatttgtacgtgaaatacattaattaattttctgaatttgtttccaatttctcgtcgtcaggcaatgccgcaatgccttgtcttaaagattgcaaattgaatgcgccatctccatcgatctctctatctccattgatggctgcccaaaaaataaaaaataaaaagagccgacaatgtttaaggagagaagcatacgcgcacgtttcgtgatgaaacatacatgcaagactaatttcgaattatatatcacatattcgctctctgaatgagcgtatcgggtatttggaatttcgtttgatatgtaaaagttgaattttaggttacttttttgtggaataatatatcataaattaatattttttataactatttatgtgacatgtaaatgacgagctgatatcagtttaggataatttcctcgctaggtgattgaacgaaccctgcacgcggcagacgtcgtggctactactatctagctagctagcgttggttacgcgtggctactatccagccagaattggttacgccgtcgcccatcgatccgccacaccacgccaaacgcgaacttaattgctactatccgatagtatgtacgcgtactacacaaaagtggggaaaagaaggttgtcctgactccatgagaagacgatccaaaacacggggccggacaaccaaacaagctagctagcggccggcggcgagccaccgtcgtcgttgctgaagacgtcgactaatttggcctcccggccggcgccatcgatcatctcaaaattaatactccctctgtataagggattttgagtttttgtttgcactgtttgatcactcgttttattaaaaaaatttgtgacaatataaaaaacgagaagttgtgcttaaaatacttcggataataaagtaagtaaaaaataaataataattctaaaaaaaatttaataaaataagtgtgcaaacaatacaagcaaaaactcaaaatcacttataatcatgggacggagggagtatatagtatccaaaaatcatctcaaaattaaaaccgaatcgaaactcgccgggccgcggcccgcccggccgtcctggcccaattaattccggcgaccgctgcatgcaacgctccgtacgtgatcgcccagcggctcgcgcgcgcaccacgcgtccacgcgtctctctcctttatacatggacaatggattaatttacttgtagaaaaaaaaacacgaggctagcttagcttgtgcccggcccagccgcgtgcgtgatttccccaagttcacaacctgtacgtgtgtgtggtacgtagcggtcgcaatcccgtttcaaatctcgatcgtgtgtggtgccattaactccgtctggttggggaagccggtggcggatagcccgactgacaggtgctgtggcctggcggccggccggccaatcgatggatggacggatggatcccatcgatgatccttcgttgattcgcgtcaacctctcgctgcccgaatcggactctcaccttccccgccctccaccgctgtgaccgcgcgctgtctgtcccttggctaataccagtcgcagtgcaactgtgcaagtgtttcacgtatataaaagcatcccgagacgcagcgcgcatgaccagccgcgttgggtgcaaaaccacaaccgccaacatcttctaactcccctcacggctctccctctccccgcacgcacaacaccggtgaacccctacgtactactgagctgagctgagaggacgaagaagaagatcaagctcgaggggcttgcgatc

SEQ ID NO: 100 - DNA, 3380 bp, Arabidopsis thaliana
aaaagatcaactattttcaaaacccattttagactccaatacacatgatcacggtgtgacgaaagagagatagctctatatataaactcagacaacgattgataggcactgatggctcaacgaatatactttaaaattgcaatacaataggattgtgaagaatatctcaacctgcaacattatggtgaaaactttaaaaaacaagcaccgatattatataaagaaattgcatgcattagtcatacgttatatgtatatatattgtgtgaaaactcataccttatactatttgatatagaatatgaatgtcataaaccacaagcatttgttaagtataattttttgtatacttattatcttatctttctgattatttatagattttaagaaattaaatctttttttttggtatctgtgtgttactttttataaatgtattttgaaaagtattatttcaatttatagataaatataattatgactctcaagtggatttttttttcacggtcaattggagtttggctgtgaatcttgtgaataatatcaactaattaagagtcggccgatactccgtatctttgatcactttcacccatatcttgaaatttaccaaatgttttctttcattggggtttctataccttttttttttggttctttctgtaatttgggttttaaagaaaaaacctataattacaaaaaaggttaaaagttaaaactaagcacgttcaaatatgttctttcgagatcccaccttcctgtctatcttataagaagtcgaacacgtgtgctcgttgtgtgaattagagtggttatttcaacatatataattaaactatgtatgtatcataaatacactgaatatgttggagttgggtcttgtggtaggctaacttgttcgcttcactttggtttagtttagccttgtaatcggtggtttcatatactgaaatttttaattttctaatataatccagatgacaaaaaaaaatcataaatacactgcaatggccatttttaaaaaaactttaaacgaaatatatatacatcaccaagtatcaagtaagtaatttggttgttttgatttttcaaaaaaacatttaggtgattcttttaacaaccaatcatatatgtagcaaagattaattatgtcaatcttttaacgtcacttatatagtttagctgtagtattattgtaagccaattgtacggacttcgtaaccgtttcgacaaagatacaaactaatcaatgtttaagatggcataatattccgacttcccctgccactcggtagtactgctgcgccatcctacaagaagcactcgtaaatgagtggttagacggccaaaaattagcaggattcaatccttgattaagagatggttcagataagccctctaggcctctactcgtcacaattcatatattaattgatcacactgcatgaaatgataagatcaagtcaattacctcaaaattaattgaaagataaaatgataaagcaacaagtaatgatcatatatggatgtaacaaccttcttcatccatacgaatatgataattcttttgtcgatcatttgccacatctatttaactaagtattttgtacattaagatcattttgcgagtattcccgcgttcccaacaaaaacgaattgaaaaactacatagggtgaattttgctctcgtggcattaaagagagaggctgacattatagattatgatatatttattatttttcttagtagatttcttgaccagcctttagatatgcttgctctgtcatggcataaagccttaaaccctaaagccctttacatttgtacagtaccaacaattgtacccaatgttaaatgaatgcggattaatttgtgatatgagaccatcaaaataaaatacttataagatagtagatatatagaaccgtaacaaaaagatgagaagaaaaagacaaattgaatagaaactggaccaaaagataaaagagtatatgaagaagcaagccaccaagaagtgtaaccatcgttgcttcaactgtaaaccgcacattaaatgtgtgtgagagaaagagagatagactccagctgtgagagctacgtccattgcatcaattgggttatatgtcgttaacaattttttaaaaatacataaataaatcaataaaatatttagaaaaaatcaatattataatgatattttgaagaagttaggtccataatggaaatatagagacttagtgtctatttatcaagaaatagtgtctatttatcaagaaataatgtctatttggtccacaattatcatattttttgtggccactcaaactacgaaaataatgaatattgttaatttttgtcttatttaagtctataactaacttactaattcggttgaaattgctaatatgcattttccttggtccactattacagtgctactgctgtcttattcttgaacacaaaataaaaaagatttcaaacacaaaatatgcatttttttgttccaccattacaaacctttatttggagaagtatacagttggatattaaatattttaattaaaaaattgaaaatattgaagttctttttctccagtattttggctggagcaaaactaaataaattccaaattaaaagctcgaacggaaaacatttactatgcaccaaaataaatgttgatatgaaatttgcatcagcatatacagtatgtatgtagtacaattgaacagagtcaaaattaattgtcactgaaacagtcagattttatttctgttaaaaaatattttcagacaaaaaatgattttttaacgtttttttatataattttattaaacctcaaaacattcctcagcagattgttttataatgttattattattttttcttaaataattttatttgaatttcgttatagagagataaataaaagatttttggggtctagttggctctcatagtttgaatgcttatataaggaaacagagctcgaggctctcaataatgccacataaaacacaacaccaaagcctttataactctttctggggtttttaattctctcaacgaacaaaaaaaaaaactcaactaatattctccatcctctttcttcagatttaagagaaaccttatcgttatattctctcttctcttttctttttgactcccacaagaagaaagcaaatttctttttctcaggattgcttgaaaactgtagaaatctttaaggtttttttacaccaataagagtcagagagagagagagagagagaaagagagatctattcataaaaaagacaggtaatctcaactccgaggagataactgatataacaatttgagagaataagaagaagaagaagaagaagaccaagctaaaga

SEQ ID NO: 101 - DNA, 3292 bp, Glycine max
cttttaatgaatcttaaagagcaattgcggaagttaattgaatctaatataatgtcttgaatttataatatatcataactaatagtatttgattttaagatttcaaaagcctctcaatttgaattgcttcgtagttggtattgaaataataaattcgtcactttttataaaataaaaaactttaaaagtgtcttgatattacaaatgtaaatatttcatgtatttacaatcggtagtacacattttaataacttttttcacaataatattttttttctgaaaaaattcaaaacctaaacaaaaacataagccaaataaagaaactcatctgaaagagaaacacaatcatatagaaaattatacatcttaatatgtaaatgaagagtttagaataaaagaaatagccgaatgtgtgttgaaagtaacaataagagaaggccccaccgagagaagacttgaacaaaatcaatttaaaatgagcaatacaaaagatttgcaatttaaaaaaaatctcaaaagaataaattttcgactaccagtaattggattttaaataggaagagattaaaaaaccacctcttaatcttatattccatcttccattccataagattgtgggtgtcattaaaacttattatcaatacaaaatgaaaaataaagagtcacggtttgttgaggagaagaatgcacttagttccaaatcccaatacatgtattaagtagtttcgttaacttttttttattaaattttaattatgttcaattaattatcaatttctataattaatttattattttaccccgaatttgagggggaaaaagttaaacttataagatactttccatgttttttaaaaattgcattcaatatttttcttttttttttcaccctaaaaaaatattttaattagttaactcacattacactcagatccccttaacagaaggtccatgttgatcacattatttttaataaaaaattatgtctaaaataccctcaaataaattacacttgcacttccatgtgtttttttaaaattacatctaatattcctccttttttgtacactataaaaaatctcttaattatttagctcccattacattcactaagacttcttccctctcctaaacacagtttaataatttaatagaaagtagacacaatttgatcatatgacttttaatgaaaatttatatctaaaatattcttatcttcttcctcttaacttcataaaaaacataacattattttgaacctgaaaatattttaatacttttttttctctaattgaacctgaactcaccttgttggtacgtatgtgttaatatctttccttttttttttttacttcaattttttttgtgtgttgagttgtttggttgcaacatttttgttggacatgttcccaacaatgccaattgattgaatatgatcatttgcttcaaattttaatgttttgttcatgcatttgtgttttaactcctttctttgaaatatttatttttgatgactagttgcttgatataatgtctcaatcaagagtttatatcttcttcgagtaatagcaacaacgaagtaaaaataaaatattaaaggaaaattgttattgtcttaagaaaaattcattaacagagtcaattgttaatttgttattgagtatttaacaaagatgttaggacaatttcatctgctcatatattccaattgatgttaattaacgacgttaacggaaagagataaaaataatgtaaaaaaaggaaggtatatcagatgcaatttgagaaaaacacaagaaatacgattataacaaaaatgttaaaacaattttatctgttcacatatttcaattaacgtaacaacgttaataaaaaagggataaaagtaatataaaaaagagaagtatcaagtgtaatttgaaaaataaaaaaacacaagaaatacgagtagtgtaattttttttagattaaattaaataataaagtctttgttaaattaaacataaggttactttataatgctctcataatgaaaaccggatttagaggtaactccaaacctaccttatctaacagctgagaggtactgtttcacctgccaaccatataaggcatttactactactctccagatctcttactgctggattacaacacgctacagcaacacgacgcgcggggtgtgtgttttcgtttacgtagattttaattttttaaggctctaattataattaattacagcgtaattaatatggagtactataaagtataataattataataagccatgtatataaaaaggagaagtgtatctgttaatgtgtactaatatcttacacaaaagtatctgataggagtgctcgtgaaatgaaataaaatgatgttattaccagaataacaaatatagaatttagctaacatatatagttaggttaaaatgtttttatataaatatttaatagaaaattacattctccttacattatagttagcattaacgattaagatgatataataaaatgatcaaatcttattaaatatctgtctaaaaataacttaaactaatataatcggtatataaacttaactcttaaatacaacagtgattaaaataaaatcaactttatcaattattatatttaaaaaattaaatagaaataattttatgaaaaaaattactataaaatgcattgataatattgaatactaataatttttaatagtttgtttttagaccaccaaaccagaatcaatcaagggagggttatttcagcttaactaagtttttatatattattttatttatttcataagattaaaatctcaagtgagatacatgaatcaaatagtagtacttttttttagaatatattaattgataatttaatgtcccagttagcagaagacaggtgggagactatcttactttgtaggccacaaggatcaatgcatgatccgcagcgcttataaatacgtgatgggacgaaagaatatatttttaagttgtggctcaaaagcaattactactaagaaaggataaaggaaggaaggaacacttttctgatattctttttggtattgggttgctgacctttgctagtgttatagattttttgggttctcttgtgttttaataaatacaggaaaaaaaaagtatataggtgcctagaagaaaagacaatatagggtgtggagcaattacgtttgatcacaagggaaaaggtgcaacggtttgcaagatagcatagaagattttgaagaatcttaattgcaacatagtagtgcagttgca

SEQ ID NO: 102 - DNA, 3000 bp, Arabidopsis thaliana
gatggaattgtctttgtagaaaagtctagtctttgctatgtttctaacggtctttggtttgtttctcaatgttcaataatgttatgtaatggtaaatatttagcagcggtatagttcattctcttgatatcggtttcaaatttttatttgaggttgaaaccacatgaacatggtcgatagtctggtcttttttgatgttaacattcatataacaattagtttagattgagctgtggtagaattttgagccagtgctgctaattggagtttgtggtaatctagtaattaccaaatttaaccaaacaatgaaaatgacgttgtcctttatatcatcaatcaggggaatgggaatgaatattcctctttacttttcaacctttttttattcaccaaactaatttcttcatgactctgtcataccaataagagaagccatacgacattttttttattttgtggcagactcttatgtgtaaattattttgtgaccaactcttgctggtcggttattctgtggaaccgacattcccatgtgctccaaaccgaaccaaaccaatatgttccactacttcctttcttcttcttatgaaattgttttccatgattttgttattattcagttctttttaagtgcgatgatccataaattcggttcaattaattctcactttataaacactctaaatatcatcaacactatataacctcagtttttgtatgtcgttttaattctgtcatcagctttgatatgtttaaccaacatgattttgtatataacaatagtttagcgatttggttgttctccttaaatagagatccaccaagtcatatgtgatgtggacaccgttttgaccggaaaagtcgacgaattatcatgtttttcaaacaaacttgacgtaaaaggttcaattctttgtttgcaacgacgaactcatgatcacttctcgaccgaatctacaacgaaacccatatgtttcttctacccaaaaaaaagtaaaaagagatcttcgagtcatgttgacctttacgacttcaactcatatttgtcctttcaaaatttgtcatggccatattgttgtctcatggagaaacacttttgagccaacagtcggaaaacaaccatcacttagcatttttttatttttaatactactatttttttttttgtaattagtcgagtgtaccaatcccaaatttaatgggtatctttcataaccaaaaagaaaaaagcacaaaaacaaaatactactactatactataatggtgaaacacacattacattagcattaaccgctattccttaaaagatatatgagcagactacaaggaagtacatttaaatcagtgtgctaagttttctcaattatcaatctaataattgtacttacataaatttaccaaatcatctcaccatttagggcatacaatttttgctcaataatggagcttgaaaagactaattatagaatgtctttttggttgacacaagctcgcttcttcatgtcgtttactttaaaaattgtagattctttcacaacttataagattctatagcctatttgattatcctttaggatgatgagtataatatctcaaactataaaataaaaatgttcacatcaataattgaaaaaaaatgcatgtatgaattcacgaaaatatggttacggttgtgtgttgctgctagacaaaagtctttcatatattcagttatatttcttaaaactaatcaaaattgttttatgcaattttggcgagtagagagaaaaagcgcgtgggataaataaagaaaggcgttataaaaaaagagaaaaagtcaaccgagtagttctggtaagagagtctcgtgcattcgtaaggtttccaagagtccacatatctatttcatcatcctcttaacgtttttctcacttacttttttccccactcttaattgattccgttgataaaatttgttcgttatatagaaataatcagaatataattagggttaattttggagtaaagaccattcaatcaatggtttggcttgattcttgtttgaaattctatgtttaaaaagggtaatacttacaaacttgactttattagtattttaaaaaatgacaaaacttaaaatggatttgaaatctagcatatttaactttaatacagttttggtttaagtttcactctcttttctatcaaaaatataattttaaaatttgaaagatgttaaaatagacaaatgtcattagtttgttcagatttagttatgtttttaatatacagacaattatattaaaataataataaaaaagtcagatcagttataaaagaaagtcagttcagttttaagacttaagtttgagtcttttggatttgaatttaatagattcacttttattaaaaattgttgaaacactttttaaaaactaaaacatttgtcaaaaaatgcatttaaccaaaaaaatgaaaatgaaaggtagtaagtaataaaagaagaaaacaaaatctaaaaaagtgtctttaaaatctcaaaattaaaatatacaaaaaagtacaagaaaataaaagaaaagggggaaaaagagagtcaatatcaacatgcaagtgtgaatattagactcttcttctctcatcagttaccccaaaactagggtttacccattttcatcatcttcttcttccccacatcactctctgaaagacaataagagagagagacacacacaccaaaaaaaaaaccccattgatttttaagagagagagagagactgagaacgaagagcaaatgagagagaagttgaatcaaatttccgctttcgttctctttctctctcctccatttcagtaataaacactccttcctctttaatttttctgggtttcttcttcttccctcttttgttgtttctgtgtgattcagttctcgatccatcttttcgtgaaaagtatcaatcttttaattctctagttgtttgtcaaatctggttagtttcttctcttgtatttatttg

SEQ ID NO: 103 - DNA, 2983 bp, Zea mays
taatgaggcataagggcatgtacaatcccataattaagagactctaaagattatgtaaaaaattaaaaagatagactctttgtgaagagtctgtctctacacgatagagatggcgatgagacccgatcttcgatttctcgctgggtattcttcattaggtggtgtgaatgtgaaaatttcttccccacggagatataacacagagaaaattcttccgcaaagagtaacccgttaaaccatgtgacgacgacattttcatgtaatagttaatgataaaaataaataattatgttgttaatatattatttattctataaatgtgttttttaatgtacacataatgatttcttacatctcaaaatgtatataagcgacaaagttttgcattaataacatatgaagtacatcataattagaatttaaacggggaacgatggtggagaataaatgtccccgcaagcgttcgtagggatctttgcgggatttttttttcgtcgcgggcccgaggatgggagctaaaacccaacgagaaatttctcattgctatccctactacacgacactatatatatgtattgtgtattaactgtatttatgatctaaaaattcataactctatcgtatagtctctcttagttatctctgtacctatcgatccaagagctcatgcttgtacatatcctaacaaaagttaggcaacgataccgattgctatagcttctagggacatttcattgcggcacatttacgttgggaaacaaactatcagggtgtacattgtgttgtgtgcattcatggtacgtaggcagagcgttgaacatcatgttttaatgtttatcatcagatataccgttgttccgactaataagtaaattgtacataaatgtacaatatttttttaaaaaacatgtagtcagagctcataagtttatccgtcaatcatttaaaaaagatatatttgaattggtaattaacatccacacaacgtcattagactttgtttggaaattaaatgcccttggcaatttgtaactctatgaatctgttattatttttgttcgaataaaatgcattcgtcgaagtcgtatgctgacacctaccagtgttcagaacgacattcatttatcgctggtggtggtaatatagatttgatttttaaactctaagcacaagacacaattaaggtagatacagtggtgtgtctaaaacctattatatcttactacatttatttcaccaatatattaatcaactacgtcttctatcttgaggctacaaacaagagacgtgtgtttttttttttgcatttagctcttagacacgtacatgctctaaggaaggaaagcatcacaattccatgttagtacgtgtctttttttttcatttttctggcagagcacttacttgtaatgacattactttcctttcgacatgtcgatgtttttgaaaaaagaaagataagcttagtggtattctacgaaagacagtagaaaacagatactctcacatatatctacataagtatactaaccacataaacattttagaaagttggcgaaggacgactgtgaagtcaccgcaagaatttggatatcggagtataacctatcacataaaacaataatttgctaaaaacacacacacacacacatgacccatacggtgttagtactcgaatatgcatgcatggtgtacatggaacatacccaagtgtgccttgctgatgagaaacccatgttctaggggagatggcttgacgctaatgcctagacggggcatttatgagaataaatgtggatgtggcgcccatgcattttcgatccaaccatgcggaaaatgatagccagcattgtagtattaggagtagtggttagcgagaggaagtagggaggccgagctggtcgtgaggcggacctgctgagcgtgagcgggcgccgccgccgcccagcagcagaagtccggtccggtccatccagcggagccaagacgccgacggtagtacctctcaccaaacaaaggaacgacggaggcagcgcctcaatattcgtgtgataacgcctctgccaggcgcgtgggcccaccggtccccgcacagctcggtccgtccacctcggcagcattcactcgctgggtcagcggccccaacggcctcggcctcggcgtcggcccggtgtggtgttgtgttcttccgttccattcccccgtccccgtccccgtccgtccccccgcccggctggctggctggcatgggtcgggtcggcattgaatcgccgcaccaaacccccgtcggatccagatcacacggccccccacagtctcgaccccatccttccagcacggagtcggtgacgacaaacaaggcaacaaaataagcggcccgccccctttgactgcgctccctgcctgtgtgcccgagccccagggcccaagcgcctctctctctctcatcagcagcgacaccggggaggacaggggagcgtcagcgccgtctccactctctctcgaccgaccccatcccttcccttccttcccttgccccccccagcctttttcatgcgtccacaccacacgcacgacgggactcttccttcgctggacgactccctgtgcccgtctcgtcgtctcctctcctcacctcccctccacccccacttgctattttgaccctcctcccgttcctttctttaatccatcatccgcctcgctatccctccctccctccctccctgcccgccgtggagggtttgggattttgcggacctcagcagctccatatctcagtcacacactcacgcgcgcgcgggggccgggggccgctggacccgccgttctccttctcctccccccctcgttcctctcgtctcaccactactaccctacacgcgccgcggctaggattccgccgaggagacgctgcgcgcgtggatctccggtgctgtcctgctagcgtgcgacgaggccaggcaggcgcgcggccggcgcc

SEQ ID NO: 104 - DNA, 3000 bp, Oryza sativa
aaatcaaaggaaataaaaagattgaagatcctaaggattcaggtactatagcaccatttggtttacttgaatcagtcactaaaagcaaaggaaagtttcctactcgagcgatttcaaggggaaaaacgtgggggaaaaaacatgcactatgagctttttttctttttctttttcttcccgtgggtcgtgggaatgacaagcgaagtgcgatcacgtgatggccatagacttactgtattgatttatcatagctttactttctagtatattcattaacatgcatgtaaagttttcaacagtgtaccttacgatatctacaagtctttatttgttttataatccctattttacacaagcaaccgtgtccaatttctatgtccttttctaatcaccgttctaaaggtgtccttcaagtttatttcgtgttgaagcaggagacaaactccatcccctattcgaccgaaacattttctttctcaccaaccaaagagggttttacttatggtaaatacttctcgacttgtacttctaaccaaaaaggttttacttgtagcaaatactttttgactcatgagacatataaatttcaaataaccgacgcttggaaagaagtgttagagcctactacaagaggaaattaagtgctattcaaatagggctgatggagcgtgaagattagaaatcgtttttatgcatcggaagggaaataaggaccatccattggcaagcacttaaggacaatggctggattaatgaactccggcagcttattcatgatccatatccaaccttctcccatctgcttatgccttggactaaccatcccttagagggtattgtgaaaagatccttgattcctaatgaaatgatgaagtagtggtgtgatatgtcgtcgagcgaggaatattccttggaaagatgcctcgggaaccactctaaccactcttgcaagctagcgccaaaagatatggggaccacataaatgtacaaccatacccttaggtttttagcatgacatggatattgtagtaacttcctatgtatcctccggggtaagattgtaacttcacatctacctccagggactgtgtaagccggtaataatcctgtagcacgacacaaacataatcaatagtaaaataacacactacttgtacatattaggctttgcatttcgagttcatctcattttcatgatatgcgggggaaataatatctcctcacctatcccctatttatctgtgacaagatatgatagatctatttattttggatggagggagtagataaacactaaccaaatacaggaaacataggttaaagtgtttggatgacgctaatgcagatgaacccgaattcatgcgtcacatgaagcgacagataagatttggtacctaccaaccaggggctgtccatccaaacttcacttcctacaagactggaaagccggactgtgatcaaaattgggcataccatgcctgatgattggccacatccagccctgtttatgacgcgattactgacccatgaacaaccaatgaagattctatatcaggtcgtaggatatcttgacagcaacagaaacaccaaacgatcgcagcatggcaaaaattaaacactctccaaagatggggatggtacgaaagataggccgagctggtcgtgaggcagacgcctcctcctcccccgagctcctccccggtccagcccagccagccagccggaccagccaggacggttcccttccacctactgtaacaccattgaagcgcctcaatattcgtgtggagcaagccgctgacgccgcccccaccgtcggatccgcggtcgggccccacatccgccgttcactgggccgccggacccaccgcccacgccgcggccagtggctacgcgctgcattaacgcccgcctccataacctcccccctcctcatcccggatctacgcgtgcgtggggcgaaagacactgaccgtgggcccttcggctaccgtggggcccagcgtcatggactggctaggctagggagctctgtatgaggcatcctgtgttttctctggggcgcattcaattctgcaccaaactgcaacccgtcggatacagatcacacggcccccacacccgcgcggctcgcccactgaccatgggcccacggacgccagcccaaccccggcctgcacaacgtggcctcgccatctcccgaccgctcgatccccccgtgtcccgtccgtccccgtagatcaccggagagagatcataacggccacgccggcacacggcgcgtacggcgcaccggtggaggagaggaagcgggcaccggcgcctctgacccaagagagacctgaccgacccctcctctctgctgtgcacttcacccgcaccaaggcaaaaaaaaaaaaaaaaggcgacgcggaacgcaacaaaatactaagcgcgcacgcatccatccggccgtttgaccgcgcaacccggctgctgctgccgctgcctgcctcagcgtcgtcagcgtctcgccatccccgcccccacctcacccccacgctccgctggttctatttttctctcgcgtccacacgacgggggggcctcctctcctctccctcctcccctcgtctccacactagacttgccattttgaccctccgcttgctccctcctcccgttcctatctccccgccgccgtacataagtgctttctttaatcggatgcgtcccctcccctcgccaccagttcgttcgctcgctcgctcgctcgctcgccttgttaatctatccctccctctctcccgcccctccgtccgccgtggagggttagggttttgagggttcgctcgcctcggcgaggctttatctctctaccagtagtctcttactcttcttcgttgggccgtgggttaggaatcgggttgtgaggcgtgtgggaggggcggggtagatccaaggaagaggactttctcgagtttacgccgtggtgttttgcttcggcgaggaggcggcggc

SEQ ID NO: 105 - DNA, 845 bp, Hordeum vulgare
gtggatctcgatgtgtagtctacgagaagggttaaccgtctcttcgtgagaataaccgtggcctaaaaataagccgatgaggataaataaaatgtggtggtacagtacttcaagaggtttactcatcaagaggatgcttttccgatgagctctagtagtacatcggacctcacatacctccattgtggtgaaatattttgtgctcatttagtgatgggtaaattttgtttatgtcactctaggttttgacatttcagttttgccactcttaggttttgacaaataatttccattccgcggcaaaagcaaaacaattttattttacttttaccactcttagctttcacaatgtatcacaaatgccactctagaaattctgtttatgccacagaatgtgaaaaaaaacactcacttatttgaagccaaggtgttcatggcatggaaatgtgacataaagtaacgttcgtgtataagaaaaaattgtactcctcgtaacaagagacggaaacatcatgagacaatcgcgtttggaaggctttgcatcacctttggatgatgcgcatgaatggagtcgtctgcttgctagccttcgcctaccgcccactgagtccgggcggcaactaccatcggcgaacgacccagctgacctctaccgaccggacttgaatgcgctaccttcgtcagcgacgatggccgcgtacgctggcgacgtgcccccgcatgcatggcggcacatggcgagctcagaccgtgcgtggctggctacaaatacgtaccccgtgagtgccctagctagaaacttacacctgcaactgcgagagcgagcgtgtgagtgtagccgagta

SEQ ID NO: 106 - DNA, 1995 bp, Setaria italica
ctttgccgtgtgattttacttctcgtgtgtcatgaacagtggaaatcgtgcgaatagttgtgtctgcatctgcaccgtctcgtggttgcggcttcgccgaattgcattctataacaagctcattacgcgcttctgctccgaaccatactgaattgcattctataacaagctcattacatgcttctgctccgaaccatactatgtaaacgaactagtcatcttttttactaacctatgggttataagcaatagtgcaaaaaatcggaccggttcactggctcaacagaagaaatcgtgaacccacgactcggccagtttggttcaactaaaatcaaccatgtaattagaccggtgacaacccgtagaaatgaacggttatgtgtgtcgaactagcggtgataaatttgatgttaatttggaccttaatttgaaactatcactactggagatctgcttttagtaccggtgccaaatgcgcagtccctgggactcgaaatccacgatctccatcctcgcgcaaggcttctttaccacctcatctacacatcacaagtgattgagttggaattttggagaggcttttagcaccaaccttttagtggcctttagtaccgggtcgtaataccatccggtactaaaaggggtcccttttagtaccgggtggtgttatgttccggtactaaaaggtctctagcgacctccaaatttggacacgaagcattattattggatcaataaaaggtctctagcgacctccaaatttggacacggagcattattactggatcaaaaggcaaccggtattaagaatgaggatgaaaggttagcgacctccaaatttggacacggagcattattactggatcaaaaggcaaccggtattaagaatgaggatgaaaggttagttttccagtagcgatggacaataggctataacaatattgctatgccgtcacgtttattatgtcatatatatgtgatatttttggatagatcttattacgatagaaataattgcatatatttcataagtcatgagaaataaattaatattgataaataaaataccgcgtgttggatcggtaaactaacgaacgggtagcctggtttcatctcggacccggctcccgttctaacggcatgggagaacacgatatgggatgtcgagacgaggcatgactctctgctttacacctccagctctttttcttttcctacggtccgcttggcagatataggtgtttatttttaatacaattttcctaaggttaatttatcatgccatagcctattttttaataatgacgaaaaataacgatgaaaaaaatcggaacatatattttataagagaacaatgggtgtgtgacaagattactcctagctagtagctagcctatgcgcatttccttgctccacggtgctatccatcacaagacgagaagcgacatgagaacgataaaaacaagtcaaaatgtagcaaaggggattctgaccaatccagctagcagtcagcaagtcacgggaactctgatcgatcgatgcgctagctctagccagcgccagccccatgtccgatatgccgaccatgcacaccattcctcgcaagtcgcaaccgctgacgatgctccgagctccaccctgagatgtctacttggattgaaaaagagcccacttggcaccaagcgacactccaaacgggggcagaatgcatacgtttccagcaaatccagcgtcgttaccgtcgacatgccctaggagcgttcatacgtttttttaccggtagaggcatggcgatttggattggcggatggctttggcttgcccgtgacctggcacgcgccgaatggatcgaagcgcgcgagcactagcacgtcacgggccgcgctatccccacgctatataaggccgccgccgtcgtccgacgtgatcatcacacgctcacacgtcgcaagcatctcatcacacagcagtcaagggggatcgtcgatcgggttg

SEQ ID NO: 107 - DNA, 17 bp, Zea mays
tgacgtaaggtatgacg

SEQ ID NO: 108 - DNA, 14 bp, Zea mays
cgtaaggtatgacg

SEQ ID NO: 109 - DNA, 22 bp, Zea mays
aacaacgtaagcgcttacgcac

SEQ ID NO: 110 - DNA, 16 bp, Zea mays
acgtaagcgcttacgc

SEQ ID NO: 111 - DNA, 14 bp, Zea mays
cgtaagcgcttacg

SEQ ID NO: 112 - DNA, 14 bp, Zea mays
cgtaaacaaatacg

SEQ ID NO: 113 - DNA, 14 bp, Zea mays
cgtaaacgcttacg

SEQ ID NO: 114 - DNA, 17 bp, Zea mays
tgacgtatggtatgacg

SEQ ID NO: 115 - DNA, 14 bp, Zea mays
cgtaaggtcttacg

SEQ ID NO: 116 - DNA, 14 bp, Zea mays
cgtaagtccttacg

SEQ ID NO: 117 - DNA, 14 bp, Zea mays
cgtaagtgcttacg

SEQ ID NO: 118 - DNA, 14 bp, Zea mays
cgtaaggccttacg

SEQ ID NO: 119 - DNA, 14 bp, Zea mays
cgtaagaccttacg

SEQ ID NO: 120 - DNA, 14 bp, Zea mays
cgtaaggacttacg

SEQ ID NO: 121 - DNA, 14 bp, Zea mays
cgtaagcacttacg

SEQ ID NO: 122 - DNA, 14 bp, Zea mays
cgtaagggcttacg

SEQ ID NO: 123 - DNA, 14 bp, Zea mays
cgtaagcccttacg

SEQ ID NO: 124 - DNA, 14 bp, Zea mays
cgtaagtacttacg

SEQ ID NO: 125 - DNA, 14 bp, Zea mays
cgtaagatcttacg

SEQ ID NO: 126 - DNA, 16 bp, Zea mays
gcgtaagcgcttacgc

SEQ ID NO: 127 - DNA, 16 bp, Zea mays
aagtaagcgcttactt

SEQ ID NO: 128 - DNA, 16 bp, Zea mays
acttaagcgcttaagt

SEQ ID NO: 129 - DNA, 16 bp, Zea mays
acggaagcgcttccgt

SEQ ID NO: 130 - DNA, 16 bp, Zea mays
acgtgagcgctcacgt

SEQ ID NO: 131 - DNA, 16 bp, Zea mays
acgtaggcgcctacgt

SEQ ID NO: 132 - DNA, 16 bp, Zea mays
acgtaatcgattacgt

SEQ ID NO: 133 - DNA, 16 bp, Zea mays
gatcggtataccgatc

SEQ ID NO: 134 - DNA, 10 bp, Zea mays
  misc_feature (9)..(10): n is a, c, g, or t
gcttacgtnn

SEQ ID NO: 135 - DNA, 10 bp, Zea mays
  misc_feature (9)..(10): n is a, c, g, or t
acgtaagcnn

SEQ ID NO: 136 - DNA, 16 bp, Zea mays
acgtaagcgcttacgt

SEQ ID NO: 137 - DNA, 20 bp, Zea mays
acaacgtaagcgcttacgca

SEQ ID NO: 138 - DNA, 18 bp, Zea mays
caacgtaagcgcttacgc

SEQ ID NO: 139 - DNA, 15 bp, Zea mays
acgtaagcgcttacg

SEQ ID NO: 140 - DNA, 15 bp, Zea mays
cgtaagcgcttacgc

SEQ ID NO: 141 - DNA, 13 bp, Zea mays
cgtaagcgcttac

SEQ ID NO: 142 - DNA, 13 bp, Zea mays
gtaagcgcttacg

SEQ ID NO: 143 - DNA, 10 bp, Zea mays
taagcgctta

SEQ ID NO: 144 - DNA, 10 bp, Zea mays
  misc_feature (9)..(10): n is a, c, g, or t
aagcgcttnn

SEQ ID NO: 145 - DNA, 21 bp, Zea mays
ctgacgtaagggatgacgcac

SEQ ID NO: 146 - DNA, 16 bp, Zea mays
gacgtaaggtatgacg

SEQ ID NO: 147 - DNA, 15 bp, Zea mays
acgtaaggtatgacg

SEQ ID NO: 148 - DNA, 13 bp, Zea mays
gtaaggtatgacg

SEQ ID NO: 149 - DNA, 12 bp, Zea mays
taaggtatgacg

SEQ ID NO: 150 - DNA, 21 bp, Artificial Sequence
  EME 44
ctgacgtaagcgcttacgtac

SEQ ID NO: 151 - DNA, 21 bp, Artificial Sequence
  EME 45
ctgacgtaagcgctgacgtac

SEQ ID NO: 152 - DNA, 21 bp, Artificial Sequence
  EME 46
ctgacgtaagcgctgacgcac

SEQ ID NO: 153 - DNA, 16 bp, Artificial Sequence
  EME 47
acgtaagcgattacgt

SEQ ID NO: 154 - DNA, 21 bp, Artificial Sequence
  EME 48
ctgacgtaagcgattacgcac

SEQ ID NO: 155 - DNA, 21 bp, Artificial Sequence
  EME 49
ctgacgtaagcgattacgtac

SEQ ID NO: 156 - DNA, 21 bp, Artificial Sequence
  EME 50
ctgacgtaagggattacgtac

SEQ ID NO: 157 - DNA, 22 bp, Artificial Sequence
  EME 51
aatgacgtaagcgcttacgcac

SEQ ID NO: 158 - DNA, 22 bp, Artificial Sequence
  EME 52
aatgacgtaagcgctgacgcac

SEQ ID NO: 159 - DNA, 12 bp, Artificial Sequence
  EME 53
cgtaaggtatga

SEQ ID NO: 160 - DNA, 12 bp, Artificial Sequence
  EME 54
gtaaggtatgac

SEQ ID NO: 161 - DNA, 12 bp, Artificial Sequence
  EME 55
gacgtaaggtat

SEQ ID NO: 162 - DNA, 13 bp, Artificial Sequence
  EME 56
acgtaaggtatga

SEQ ID NO: 163 - DNA, 13 bp, Artificial Sequence
  EME 57
cgtaaggtatgac

SEQ ID NO: 164 - DNA, 13 bp, Artificial Sequence
  EME 58
gacgtaaggtatg

SEQ ID NO: 165 - DNA, 14 bp, Artificial Sequence
  EME 59
acgtaaggtatgac

SEQ ID NO: 166 - DNA, 14 bp, Artificial Sequence
  EME 60
gacgtaaggtatga

SEQ ID NO: 167 - DNA, 15 bp, Artificial Sequence
  EME 61
gacgtaaggtatgac

SEQ ID NO: 168 - DNA, 11 bp, Artificial Sequence
  EME 62
taagcgcttac

SEQ ID NO: 169 - DNA, 12 bp, Artificial Sequence
  EME 63
gtaagcgcttac

SEQ ID NO: 170 - DNA, 12 bp, Artificial Sequence
  EME 64
taagcgcttacg

SEQ ID NO: 171 - DNA, 14 bp, Artificial Sequence
  EME 65
gtaagcgcttacgc

SEQ ID NO: 172 - DNA, 16 bp, Artificial Sequence
  EME 66
aacgtaagcgcttacg

SEQ ID NO: 173 - DNA, 16 bp, Artificial Sequence
  EME 67
acgtaagcgcttacga

SEQ ID NO: 174 - DNA, 16 bp, Artificial Sequence
  EME 68
acgtaagcgcttacgg

SEQ ID NO: 175 - DNA, 436 bp, Cauliflower mosaic virus
catggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgat

SEQ ID NO: 176 - DNA, 280 bp, Citrus Yellow Mosaic Virus
caattatggagcgtgatggacccccccgcaataatccaaagtttggtgtgcttttagtagtgcgtctttatggaccactactttattgtaataatcgatgctttttgtagtgcgctcttcgtgcgctctactttatgcttttgcttttgtaagtgcgctgtaagtgcgcctgtctttcttcagatgcttatcctttaagcatcttttgctttttgcgtggcatcctttagttcacaatttaaagaatgacgatggggcccaagatgtgcacccggttctc

SEQ ID NO: 177 - DNA, 293 bp, Banana Streak Virus
gccagaagatagaagatatcctggacctgcaagatgtcagcaatgacgattgaaagattcccaggatagccggcggacgtggtggacccagtctaggtgcgatgcttagtcacgcacgatgactctgtcggaaggcatctttactttcggcaaactttaataatactttaggaaaagtattgtacaagttaggtgcagaatcaataatgcacccagctttagtcttgtctactgaattattgtgtcggttgcattattggatgcctgcgtgcaccctaagcaatccccggctc

SEQ ID NO: 178 - DNA, 202 bp, Figwort mosaic virus
atcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaa

SEQ ID NO: 179 - DNA, 184 bp, Peanut chlorotic streak virus
caacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgacc

SEQ ID NO: 180 - DNA, 187 bp, Mirabilis Mosaic Virus
ccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatccca

SEQ ID NO: 181 - DNA, 8964 bp, Artificial Sequence
  PHP87078
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgagctcggtacggccagaatggcccggaccgggttaccaagcggccgcatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagcaacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgaccgtcgacccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccagggcccggtgaccaatcgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 182 - DNA, 8870 bp, Artificial Sequence
  PHP88158
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgagctcggtacggccagaatggcccggaccgggttaccaagcggccgcatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagcaacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgaccgtcgacccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccagggcccggtgaccaatcgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaacgtaagcgcttacgcccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgaagccgaggccggccacactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcccggcggatctcgactctagaggatcgctcaggaaggccgctgagatagagccatggggaggagggcgtgttgcgcgaaggaaggcgttaagagaggggcgtggacgagcaaggaggacgatgccttggccgcctacgtcaaggcccacggcgaaggcaaatggagggaagtgccccagaaagccggtttgcgtcggtgcggcaagagctgccggctgcggtggctgaactacctccggcccaacatcaggcgcggcaacatctcctacgacgaggaggatctcatcatccgcctccacaggctcctcggcaacaggtggtcgctgattgcaggcaggctgcctggccgaacagacaatgaaatcaagaactactggaacagcacgctgggccggagggcaggcgccggcgccggcgccggcggcagatccacgatggcgctttcagcttcccgagttcagcaggcggaagaactgctgcaacgacctgctgagaggcagctgatgaggagccagcttgctgcagccgccaggagcatcaactggagctacgccctcttctggtccatttcagacactcaaccaggggtgctgacgtggacggacgggttctacaacggcgaggtgaagacgcggaagatttccaactccgtggagctgacatccgaccagctcgtcatgcagaggagcgaccagctccgggagctctacgaggccctcctgtcgggcgagggcgaccgccgcgctgcgcctgcgcggccggccggctctctgtcgccggaggacctcggcgacaccgagtggtactacgtggtgtccatgacctacgccttccggccaggccaagggttgcccggcaggagtttcgcgagcgacgagcatgtctggctgtgcaacgcgcacctcgccggcagcaaagccttcccccgcgcgctcctcgccaagagcgcgtccattcagtcaatcctctgcatcccggttatgggcggcgtgcttgagcttggtacaactgacacggtgccggaggccccggacttggtcagccgagcaaccgcggctttctgggagccgcagtgcccgagctccagcccgtcaggacgagcaaacgagacgggcgaggccgcagcagacgacggcacgtttgcgttcgaggaactcgaccacaataatggcatggacgacatagaggcgatgaccgccgccgggggacacgggcaggaggaggagctaagactaagagaagccgaggccctgtcagacgacgcaagcctggagcacatcaccaaggagatcgaggagttctacagcctctgcgacgaaatggacctgcaggcgctaccactaccgctagaggacggctggaccgtggacgcgtccaatttcgaggtcccctgctcttccccgcagccagcgccgcctccggtggatagggctaccgctaacgtcgccgccgacgcctcaagggcacccgtctacggctctcgcgcgacgagtttcatggcttggacgaggtcctcgcagcagtcgtcgtgctccgacgacgcggcgcccgcagcagtagtgccggccatcgaggagccgcagagattgctgaagaaagtggtggccggcggcggtgcttgggagagctgtggcggcgcgacgggagcagcacaggaaatgagtggcactggcaccaagaaccacgtcatgtcggagcgaaagcgacgagagaagctcaacgagatgttcctcgtcctcaagtcactgcttccgtccattcacagggtgaacaaagcgtcgatcctcgccgaaacgatagcctacctcaaggagcttcagagaagggtgcaagagctggagtccagtagggaacctgcgtcgcgcccatccgaaacgacgacaaggctaataacaaggccctcccgtggcaataatgagagtgtgaggaaggaggtctgcgcgggctccaagaggaagagcccagagctcggcagagacgacgtggagcgccccccggtcctcacgatggacgccggcaccagcaacgtcaccgtcaccgtctcggacaaggatgtgctcctggaggtgcagtgccggtgggaggagctcctgatgacgcgagtgttcgacgccatcaagagcctccatttggacgtcctctcggttcaggcttcagcgccagatggcttcatggggcttaagatacgagctcagtttgctggctccggtgccgtcgtgccctggatgatcagcgaggctcttcgcaaagctatagggaacccctgggtcgtcgtcgcgccggacaccggctcgcacgccaccccggccgcgacgtcgggcgcctgcgagacgggccagaatagcgccgctcatcgcgcggaccccgactcagccgggacgacgacgacctcggcggcggcggtgtgggcgcccaaggccgtgcggtgcacgggcggactcttcttcttccaccgggacacgacgccggcgcacgcgggcgagacggcgacgccaatggccggtggaggtggaggaggaggaggagaagcagggtcgtcggacgactgcagctcggcggcgtcggtatcgcttcgcgtcggaagccacgacgagccgtgcttctccggcgacggtgacggcgactggatggacgacgtgagggccctggcgtcgtttctggagtccgacgaggactggctccgctgtcagacggccgggcagcttgcgtagtggccaggtaccactaactatctatactgtaataatgttgtatagccgccggatagctagctagtttagtcattcagcggcgatgggtaataataaagtgtcatccatccatcaccatgcgtggcaacgtgagcaatgacctgattgaacaaattgaaatgaaaagaagaaatatgttatatgtcaacgagatttcctcataatgccactgacgacgtgtgtccaagaaatgtatcagtgatacgtatattcacaatttttttatgacttatactcacaatttgtttttttactacttatactcacaatttgttgtgcgtaccataacaatttcgatcgaatatatatcagaaagttgacgaaagtaagctcactcaaaaagttaaatgggctgcggaagctgcgtcaggcccaagttttggctattctatccggtatccacgattttgatggctgagggacatatgttcgcttaagcttggcgcgccggtcacccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 183 - DNA, 7799 bp, Artificial Sequence
  PHP86491
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 184 - DNA, 28390 bp, Artificial Sequence
  PHP71539
gacccgcgaggtttctcgcttcaattgaaatcataaagaagcaattgaaaattttcgagtaaccgaccctcccgataatcttcaacataaaacaacgcacttcttccaacgggagaggcggtgttagttgcgagctaaggagataaggtatgcttaagagatcggggtcgctttctcttgccttgatggtctccttctgttcgtcgagccttgccacgccactctcatctgctgagtttgaccatgttgctcgcaagtgtgccccatcagttgcgacatctacgcttgcggcgatagctaaggtggagagtcgctttgatcctttagcgattcatgacaacacgaccggcgaaacgcttcactggcaagatcacagccaagcaacccaagtcgtcaggcaccgtctcgatgcacggcattcgctggatgttggcctcatgcaaataaactctcgaaatttttctatgctcggtctgacacctgacggtgcgctccaggcgtgcacatcattatctgccgctgcaaacatgctgaaaagtcgttatgcaggcggcgaaacgattgacgagaagcaatttgcgcttcgtcgggcgatctccgcttacaacaccggtaatttcatcggcggttttgcaaacggctacgtgcgaaaagttgaaacagctgctcaatcgctggtgcccgcgttaatcgagcctccaaaagacgatcacgaggcgctaaaatccgaagagacgtgggatgtttgggggtcatatcagcgccgctcgcaggaggatggcgctggcggtttaatcgctccgccaccgccacaccaggacaacggcaaatccgcagacgacaatcaagtcttattcgacttatactaaggaggtgcgcattgatgcgatgctttgagagataccgtttacatctaaatcgcctctcgctctcgaatgcgatgatgcgcgtgatatcgagctgcgccccaagcttgtgcggtgcaattgcatggagcatttcctcatccggacccgccgcagcgcaatctgcgggtggcggcactgaccccgccacaatggttaacaatatatgcacgtttatccttggtccgttcggccagtcactcgctgttctcggcattgtcgctatcgggatctcctggatgttcgggcgggcttcgcttgggctggttgccggcgtcgtcggcggcattgttatcatgtttggggcgagcttcctcggccaaacgctcactggcggtagttgatggctgatcgtttggaagaatcgaccctttacctcgcagccacacggcccgcattgtttcttggggtgccactgacattggcagggttattcatgatgttcgccggctttgtcatcgttatcgttcagaacccgctctacgaagtcgttctcgtgccgttatggtttgcagcccggctcatcgtggagcgagactacaatgcggcgagcgtcgtcctgctatttttgcggaccgcgggaagaagcattgatagtgcagtttgggggggcgctactgttagcccaaatccaattagggttcccccacgagggagaggaatggtgtgatgctcggcgcgagtggaacgaccgaaagatccggtgagatctatctcccttatattggccacctcagcgaccatatcgtccttcttgaagacggatcgatcatgaccattgcgagaattgatggcgttgcattcgagcttgaggaaactgaaatgcgcaatgcgcgttgtcgtgcgttcaacacgctgttgcgcaatatcgctgatgatcatgtgtcaatatatgctcacctcgtacgtcatgccgacgtgccatcatcggcgccgcgacacttccgtagtgttttcgccgctagcctgaacgaagcttttgaacagcgcgtgctctccggccaactcctccgcaatgaacacttccttacgttgattgtctacccacaggcggctttagggaaggtaaagaggaggttcaccaagctaagcggaaaaagggaaaacgatctcacgggccagatcaggaacatggaagatctttggcatgttgtcgctggctctcttaaagcgtatggcctgcatcgtcttggcatccgcgagaagcagggtgtgctcttcaccgaaattggcgaagcgctacggttgatcatgactggtcggttcacaccggttccggtcgtcagcggctcactcggcgcttcgatttataccgacagagtcatttgcggcaagcgaggactcgagatcagaacgccaaaagacagttacgttggatccatctattcgtttcgcgaataccctgcaaaaacacggccgggcatgctcaacgcgctgctatccctcgattttccacttgttctcacgcagagtttttcgttcctgactcgcccgcaagcgcacgcgaaacttagcctcaaatcgagccagatgctgagttccggcgataaagccgtgactcaaatcggcaaattatccgaggctgaggacgcacttgcgagcaacgaattcgttatgggctcacatcatttgagcctttgcgtctatgcagacgatctcaatagtcttggggacaggggcgcgcgggctcggacacgaatggcggatgcaggtgccgtggttgtccaagaaggtattggtatggaagcggcctattggtcccaattgccggggaattttaagtggcgcacacgccctggcgcaatcacttcacgcaatttcgcagggtttgtctctttcgaaaactttccagagggcgccagctcaggccactggggcaacgcgattgcccgatttcgtaccaatggcggaacgcctttcgactatatcccgcatgagcacgatgttggcatgacggcaatattcgggcctatcgggaggggtaagacgacgctcatgatgtttgttctagccatgctcgaacagagcatggtcgaccgtgcaggtacggtcgtgttctttgacaaggaccggggtggcgaattgctggttcgcgccacaggaggaacatatttggcacttcacagaggcacacccagcgggttggcgccgttgcgtggcctagaaaacacagcagcctcacacgattttctgcgcgaatggatcgtggctctcatcgagagtgatggtcggggtgggatttctccggaagagaaccgccgtctggtccgtggtatccatcgtcagctctcgtttgatccacaaatgcgttcaatcgcggggttacgtgaatttttgttgcatgggcccgccgaaggcgcaggagcgcggctccaacgctggtgccggggccatgcgcttggctgggcatttgacggcgaagttgacgaagtaaagttagatccgtcgattaccggcttcgacatgacgcatcttctcgaatacgaggaagtatgcgctcccgctgcagcatatctcctgcatcggattggagccatgatcgacggccgccgttttgtgatgagctgcgatgagtttcgcgcctatttgttaaaccctaaattttcgactgtcgtcgacaaattcctcctgaccgttcgaaaaaacaacgggatgctaatactggcaacgcagcaaccagagcatgttctggaatcgccgctaggagccagcttggttgcgcaatgtatgacgaagattttctatccatcaccaaccgcagatcgatcggcttatgtcgatggactgaaatgtaccgaaaaggaatttcaggcgatccgtgaagacatgacggtcggcagccgtaagtttcttcttaaacgagaaagtggaagcgtcatctgcgaatttgatctgcgggatatgcgtgaatatgtcgccgtgctttcggggcgtgccaacacggtgcgctttgcaactcgactacgcgaggcacaagaaggcaactcatctggctggctcagcgaattcatggcccgtcaccacgaggcagaagattgataaggtaggaaacgatgaagacgacgcaacttattgcaacagttttgacctgcagctttctatatattcagcccgcgcgggcgcagtttgttgttagcgacccggcaacggaggctgagacgctcgcgactgcgctcgcgactgcggagaatctcactcagactatagcgatggttacgatgttgacgtcggcctacggcgttactggactactgacttcgctcaaccagaaaaatcagtatccttcgacgaaggacctagacaatgaaatgttttcgccgcgaatgccaatgtcgaccacggcacgtgcgatcaccagcgatacagatcgtgcagtcgtgggtagtgatgctgaagcggacctgttgcgatcgcagatcaccggttccgcaaacagcgctggcattgcggctgacaatctggaaacgatggacaaacgcttgacggcgaatgctgatacgtctgctcagctttcccgatctcgcaatatcatgcaggcaaccgtgaccaatggtttgcttctcaagcagatccatgacgcaatgattcaaaatgtacaggcgacaagcctattaacgatgactaccgcgcaggccggccttcacgaggcggaagaggcggccgctcaacgcaaggagcatcaaaagaccgctgtcatctttggtgccctcccctaaggctgggcgatttgttcatccgcccgcatcctcgccgaatgcgagctcattttatccaacattatgcgacaaaccagtcaagttcaggtccaatcgatgaatttcacgattccggcgccgtttacggccattcatacgatcttcgatgtagccttcacgacaggcttggactcgatgcttgagactatccaggaggcggtgagtgcgccattgatcgcctgtgtcactctttggattattgttcagggtattttagtcatacgcggcgaagtcgatacccgtagcggtatcactcgggtgatcacggtcaccatcgttgttgctctaattgttgggcaggctaactaccaagactatgtggtttccatcttcgaaaagacggtcccaaactttgttcagcagtttagtgtaaccggcttgcctctgcagactgttccggcacagttggatacaatgttcgccgtgacccaggccgtttttcagaaaatcgcatccgaaatcggtccgatgaacgaccaggacatccttgctttccaaggggcacagtgggtcctttacggcacgctctggtctgccttcggagtttacgacgccgttggaattctcacgaaagtgcttctcgcgatcgggcctctgatcctcgtcggatatatttttgatcgcacgcgggacatcgcagctaagtggatcgggcaacttatcacctacggtctcttgcttctcctcttaaacctcgtggcaacgatcgtcatcctaaccgaagcgactgcgctcacccttatgcttggtgtaatcaccttcgccggtacgaccgcggccaagatcattggtctttacgaactcgatatgttttttctgacaggggatgcgctcattgtcgctttgccggcgatcgccggcaacattggaggcagttactggagcggcgcaacccaatctgccagcagcttgtaccgtcgcttcgctcaggttgagcgaggctaggtcgcgcaaaaattcgcctcaatggagaattctatgaagtattgcctgctgtgcctagttgtcgctttgagcggctgccagacaaacgacacattagcgagctgcaaaggcccgatcttcccgctgaatgtggggcgatggcagcctactccgtcagatcttcagctcggcaattcgggtggacgctatgacggggcctgaatatgccatgctagtggcgcgcgaaagccttgccgagcactataaggaagtagaagcctttcaaaccgcgcgagcgaaatcggcgcgacgtctctccaaactcattgcagctgtcgcagctatcgcgattttgggaaatgttgctcaagcgttcgctatagccacaatggtgccgttgagcaggcttgtgcccgtatatctatggatacggccggacggcaccgttgacagcgaggtgtctgtctcgcgattgcctgcaactcaagaggaggccgtcgttaacgcctcattgtgggagtacgttcgcctgcgcgagagttatgatgccgacaccgctcagtacgcctacgacctggtatcgaacttcagtgccccaacagtgcgccaggattaccagcaattcttcaactatcccaatcccagttcgcctcaagtcattcttggcaaacgcggcagggtggaggtcgagcacatcgcttcaaatgatgtaactccaagcacgcagcaaattcgctataaaaggaccctcgtcgttgacggcaaaatgcctgtggtgagtacgtggaccgcgacagttcgctacgaaaaggtgaccagcttgcccggcagattgagactaaccaacccggcaggtctggttgtcacctcctatcagacatcggaagataccgtttcaaacgtaggccacagcgaaccatgatcagaaaagcacttttcattttagcatgtttatttgccgctgcgactggtgcggaggctgaagacactccaatggcgggcaagctagatccgcgcatgcgttatttggcttacaatcccgatcaagtggtgcgcctctcgacggcggttggagctactttggtcgtaacattcgccacgaacgaaacggtgacagcggttgccgtttcaaatagcaaagatctagcagccctaccgcggggaaattatctatttttcaaggcaagccaggtcctcacgcctcagccagtaatcgtgctaaccgcaagcgactccgggatgcgccgttatgttttcagtataagttccaagactctgtcccacctcgataaagagcagcccgatctctattacagcgtccaattcgcctaccccgccgacgatgcggcggctcggcgaagggaggcacaacagaaggctgttgtggacagactacacgcggaagcacaatatcaacggaaagctgagaatttattggatcagcctgtcacagcccttggtgcggcggacagtaattggcactacgtcgcccaaggcgatcgttcgctgttgccactcgaagtcttcgacaatggatttacgacggtattccactttccgggcaatgtacgcataccctccatctacaccatcaatcctgatggcaaggaagctgttgccaactattcagttaaagggagcgatgtcgagatttcttcggtttcccgaggttggcgtctgagggatggccacacagtactatgtatctggaacaccgcttacgatcccgttggccaaaggccgcaaacgggcacggtgaggcccgatgtgaaacgcgtcctgaagggggcgaagggatgaataacgatagtcagcaagcggcacatgaggttgatgcatctggatccctggtctccgacaaacatcgccggcgtctttcggggtctcagaaattgatcgtcggaggtgtcgttctcgcgttatcattaagcctcatttggctaggtgggcgccaaaagaaggtgaatgagaacgcatcgccgtcaactttgatcgcaacaaacaccaagccatttcatccagctccgattgaggtgccgccggatcctccagcggttcaagaggctgttcagcctgctgctcctctaccgccgaggggcgaaccggagcggcatgagccacggccggaagaaacaccgatttttgcatatagcagcggcgatcaaggggtcagcaaacgcgccattcagggcgacacgggccgaagacaagaaggcaagcgtgacgacaactccttgccgaatggcgaagtgtccggcgagaacgatttgtcgatacgtatgaaacccaccgagctgcagcccagcagcgccacgctcttgccgcaccccgattttatggtaacgcaagggacaataattccgtgcatcttgcaaaccgcaatcgacacaaatttggcaggctatgtaaagtgtgtcttgcctcaggatattcgtggaacaacgaacaatatcgtgcttcttgatcgtggcaccaccgttgttggcgaaatacagcgtggcttgcaacagggagatgggcgcgtttttgtgttgtgggatcgcgccgagacacctgaccatgcgatgatctcgttaacatcgccaagcgcggacgaactcggtcgctcaggattgccgggctcggtcgacagccacttctggcagcgttttagcggagctatgctcttgagtgttgttcaaggcgccttccaggcagctagcacctacgccggcagctcgggtggcgggatgagcttcaacagctttcaaaataacggtgagcagacaactgagacagcccttaaggcaaccatcaacataccgccaaccctgaagaagaatcagggtgacaccgtttccattttcgtagcacgggacctcgatttctttggtgtttaccagctccgcctgactggcggcgccacgcgggggaggaaccgccgctcttaatgaattcaaatttccgcttagagataggatacattgtaaatggaagtggatccgcaactacgctttcttctgaagccgattttggaatggctcgatgacccgaagactgaagaaattgcgatcaatcgacctggagaggcatttgtgcgccaagccggcatttttaccaagatgcctttgcccgtctcttatgatgatcttgaagatatcgctattttagcgggcgcgctgagaaagcaggatgtcggaccacgtaaccccctctgcgccactgaacttcctggtggtgaacgactacaaatctgtctgccgccgaccgttccctcgggcaccgtcagcttgaccattcgacggccaagctcgcgtgtttctggtcttaaagaagtctcctcccgttatgatgcttcgaggtggaaccagtggcagacacgaaggaaacgccaaaatcaggatgatgaagctatccttcagcattttgacaacggggatttggaagcgtttctgcacgcatgcgtcgtcagccgactgacgatgttgctatgtggccctaccggaagcggcaagacaacaatgagcaagaccttgatcagcgccatccccccccaggaaaggctaatcaccatagaagatacgctcgaactcgtcattccacacgataatcatgttagactactctactccaagaacggtgctgggctgggtgctgtgagcgccgagcacttgctccaagcaagtctgcgtatgcggccggaccggatattgcttggcgagatgcgcgacgatgcagcatgggcttatctgagtgaagtcgtctcgggacatccgggatcgatttcaacaatacacggcgcgaatccaatccaaggattcaagaaactgttttcccttgtcaaaagtagcgcccaaggtgctagcttggaagatcgcacactgattgacatgctctctacggcgatcgatgtcatcattccattccgtgcctatgaggacgtttatgaagtaggcgagatctggctcgcggcggacgcacgacgccggggcgagaccataggcgatctccttaatcaatagtagctgtaacctcgaagcgtttcacttgtaacaacgattgagaacttttgtcataaaattgaaatacttggttcgcattttcgtcatccgcggtcagccgcaattctgacgaactgcccatttagctggagatgattgtacatccttcacgtgaaaatttctcaagcgctgtgaacaagggttcagattttagattgagaggtgagccgttgaaacacgttcttcttatcgatgacgatgtcgctatgcggcatcttattatcgaataccttacgatccacgccttcaaagtgaccgcggtagccgacagcacccagttcactagagtactctcttccgcgacggtcgatgtcgtggttgttgatctaaatttaggtcgtgaagatgggcttgagatcgttcgaaatctggcggcaaagtctgatattccaatcataattatcagtggcgaccgccttgaggagacggataaagttgttgcactcgagctaggagcaagtgattttatcgctaagccgtttagtacgagagagtttcttgcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttacgacaggagtatagatgttctcattttgcggctgcgccgcaaacttgaggcggatccgtcaagccctcaactgataaaaacagcaagaggtgccggttatttctttgacgcggacgtgcaggtttcgcacggggggacgatggcagcctgagccaattgcatttgattaatttaggtgactgaggacgcggccagcggcctcaaacctacactcaatatttggtgaggggttccgataggtccctcttcaccaattgctcgatggcttctctccagcaaagaatgacgcgagcgcggcggtagccagcttgtggccgaaagctcgagcggtctccaaccccaacggatcaaaatgacttcgagcgacctcgagcaacgcaaccgggaacatgcgtgaggtctgaacgagaacggatttttctgtagttgaagggatcggataacttttcggggccacgcgaaatgatccatctgccagcatgctttcgaaatcgtccaacgcgcgccttaaaatcatttgtagcgacttcgagggactgtattgccgaacgaggttgtcatatgttttcgacacttgaggcgcgggcggtcgcgctgaaagaaaaacctggagctttttcggggacggaggtggactaagggcatccacagttagcttaagttgtcgatcgggactgtaaatgtgatcggcgacgagaggctcacgttgctggtctttctcgtcggctttttcaggcaagtgctggaggtccagcttctggggaacaagtgtcgggttgggatggtggatctcgggtcgagcaccagcaagccgccgtgcttcgccgaccgacaatgcgggcttgcgaattgccatcttcaagcctccaagattttgctgatcagtttcgaaatgaccacgacttcctccatcgcaatccgaagattcctctctatgaggcgcatcgtcggatcagttcccgtgtttagtaatgtaagatgcaacatgccgcgttctttcatcgcggcaaatgcatctctttcatgcatgggagacggtacaactggaaggctctctagcgtctctgacatcctgcgttgcgatgttgtcaatcggccgaccgggacgcgttggcgcaaaacagctgtaggaattgccaaattttcactcaacagcagctcgatgacgtagcggtaggtagatagtgcctcatcgatgtcgagcggcgttagcatggtggggatcagaagcaggtttgagctagcgatgattgtgttgttgagctcgctcgagccgccacgcgtatcggccaacgcataatcaaatccttcgagctcggcattttcataggctgcttcaagaaggggcatttcgtcggcggaatagacttcacagcgaggatcccaggtactgctttgtaaggcgttttctctccatcgcgtcagaggccggttttcgtcggcatcaaagagggccactcgtttaccgtcatttgccaaagcagcgcaaaggcccatgagtgcggtggttttgccagcaccccctttgaaagaacaaaacgtcaaaagttgcatattctgatcccgcctatcctgtgaaaccggagtgcatttgtatttttgttcgtataaatgtttttgtgattatcgatgagtaaaagcgttgttacactatttttatttcacattcgttataagacaattgcaaatgtagcaagtatattcagtattgactgtaaatgtactgttgatttcatattgagcagggctagacttccatccgtctacccgggcacatttcgtgctggagtatccagaccttccgctttctttggaggaagctatgtcaaaacacaccagagccacgtcgagtgagactaccatcaaccagcatcgatccctgaaagttgaagggttcaaggtcgtgagtgcccgtctgcgatcggccgagtatgaaaccttttcctatcaagcgcgcctgctgggactttcggatagtatggcaattcgcgttgcggtgcgccgcatcgggggctttctcgaaatagatgcagacacacgagaaaagatggaagccatacttcagtccatcggaatactctcaagcaatgtatccatgcttctatctgcctacgccgaagaccctcgatcggatctggaggctgtgcgagatgaacgtattgcttttggcgaggctttcgccgccctcgatggactactgcgctccattttgtccgtatcccggcgacggatcgacggtcgctcgttactgaaaggtgccttgtagcacttgaccacgcacctgacgggagaaaattggatgcccgatcgcgctcaagtaatcattcgcattgtgccaggaggtggaaccaagacccttcagcagataatcaatcagctggagtacctgtcccgaaagggaaagctggaactgcagcgttcagcccggcatctcgatattcccgttccgccggatcaaatccgtgagcttgcccaaagctgggttacggaggccgggatttatgacgaaagtcagtcagacgatgacaggcaacaagacttaacaacacacattattgtaagcttccccgcaggtaccgaccaaaccgcagcttatgaagcaagccgggaatgggcagccgagatgtttgggtcaggatacgggggtggccgctataactatctgacagcctaccacgtcgaccgcgatcatccacatttacatgtcgtggtcaatcgtcgggaacttctggggcaggggtggctgaaaatatccaggcgccatccccagctgaattatgacggcttacggaaaaagatggcagagatttcacttcgtcacggcatagtcctggatgcgacttcgcgagcagaaaggggaatagcagagcgaccaatcacatatgctgaatatcgacgccttgagcggatgcaggctcaaaagattcaattcgaagatacagattttgatgagacctcgcctgaggaagatcgtcgggacctcagtcaatcgttcgatccatttcgatcggacgcatctgccggcgaaccggaccgtgcaacccgacatgacaaacaaccgcttgaaccgcacgcccgtttccaggagcccgccggctccagcatcaaagccgacgcacggatccgcgtaccattggagagcgagcggggtgcccaaccatccgcgtccaaaatccctgtaactgggcatttcgggattgagacttcgtatgtcgctgaagccagcgtgcccaaacaaagcggcaattccgatacttctcgcccggtgactgacgttgccatgcacacagtcgagcgccagcagcgatcaaaacgacgtcatgacgaggaggcaggtccgagcggagcaaaccgtaaaagattgaaggccgcgcaagttgattccgaggcaaatgtcggtgagcccgacggtcgcgatgacagcaacaaggcggctgatccggtgtctgcttccatccgtaccgagcaaccggaagcttctccaacgtgtccgcgtgaccgtcacgatggagaattgggagaacgcaaacgtgcaagaggtaatcgtcgcgacgatgggcgcggggggacctagactagtagacaggaaggaccgaataatggcaaatggtcagttcacgatacgctctgctcgcccggcctccgtcggactgacaggcgaacggcgtggagccgcatccgcctctagctctgcactgtccaatgttcaaagagatgttagggataggctgattccaactagctcaccaagattaccaaatgcagccatattgcgtgattcctcgggaagagcgtcgactggtctgcggtacatggcggctactcttcattggtctgcgatcgcgccattatcgctaataaacagcaacgacctggctccggccgcttatgactttgagacgcgaaataacgcaagaaatgtgactgccaaagtcggcagggcagtccctgttcccaagcaaggcgggctcggcaaaacgctcgcacccgtaccccttagtacacgtatatcaagggtcaattccgaccgaagactgcccgctgacgcagaagaccgccctgaaacgcgcgacccccagaaaggacgtggcagtcatggtgcgacgccaaccttacatgaaaagattggaaccgcgtttgctcgaagattgcgaaagcatacgtactatattgtttgcagttgctgccagacccggagcgcgttgacgatgggtgcaaagatttcggtgaagtcatgaactccagcaagacttcgccccagcgtatgaccctgagcatcgtatgttcgctggcagccggtttttgtgcggccagctgctatgtaacgttccgccggggcttcaacggcgaagcgatgatgacgttcgacgttttcgctttttggtatgagaccccgctttacttgggttatgccagcaccgtcttctggcgtggtttatctgttgtcatctttacctcgctgatcgttctttcaagtcagctcatcatatcgctgcgcaatcagaagcatcatgggacagctcgttgggcagaaattggcgaaatgcggcatgctggttatctgcagcgttacagtcgcatcaaggggccgatctttggaaagacatgtggtcccctttggttcggcagttatttgaccaatggcgaacagccacacagtcttgtcgtcgcgccaacgcgtgctggcaaaggcgtcggcatcgtcattccaacgctgttgaccttcaagggctcggtaatcgcccttgacgtcaagggagaattgtttgaactgacgtccagagcacgcaaagcgagcggcgacgcagttttcaagttctcccccctagatcctgagcggaagactcattgttacaatccggtcctggatattgccgcacttccgcccgaacgccagttcactgaaacacgccgtctagctgcgaaccttattacggctaagggaaagggagcagaaggctttattgacggcgcacgtgacctgttcgtcgcgggaatccttacctgcattgagcgtggcacaccaacgattggcgcggtatatgacctatttgcgcagcctggcgaaaagtataagctttttgcgcaactcgcggaggaaagcctaaacaaagaggctcagcgtatcttcgataatatggcgggcaacgacacgaaaattctgacatcgtacacctctgtgctgggcgacggtggactgaacctgtgggctgatccgcttatcaaagcagcgacaagccggtcagacttttccgtttacgatctccggaggaagaagacctgcatttatctttgtgtcagtcccaacgatctggaggtcttggcaccacttatgcgcctgatgtttcagcagctcgtgtcaatcttgcagagatcgctgccaggtgaagacgagtgccatgaagttttatttctcctcgacgaattcaaacacctgggcaagcttgaggccatagagaccgcgatcacaaccatcgccggttacagaggccgctttatgtttattattcaaagtctttcggccttgtcgggcacatacgatgacgcaggaaaacaaaactttctgagcaatactggcgtacaagtatttatggccacggctgatgacgaaactccaacctacatctcaaaagctatcggcgaatatacgtttaaagcgcgttcgacctcttacagtcaagccagaatgttcgaccacaacatccagatttctgatcaaggtgcagcccttttgcgccccgaacaagtgcgcctgctagacgatcagagtgaaatcgttctcatcaaagggcgacctccactcaaattacgaaaggtgcagtattattccgatcgtacgctgaaaggccttttcgaacgccagatgggctctctgcctgagcccgcacccttgatgctttccgactatagcaacgatcaagttcaataccacttggctccgatagcaaattttaatgaggatgctgcaccgcaaaacagaactgtggccgaggaccatggaagtgttaaagtcggtgctgatatccctgaacgcgtgatgggaataaatggtgacgaggaacaagccgatgcgggcgagataccgccggaatcggttgtgcctccagaattgacgctcgctctgaccgctcaacagcaattgttggaccagattattgcacttcagcaaagatcgaggtccgcaccggcatagcctgcgaaatgatcttaatggtgcaattcgtttcaggcggcatgttgcggttcaacaaagtgtacgccagatcccaattggccctttacgaggtgtcggtatgacaggaaagtcgaaagttcacataagaggttcggctgacgcgcttcctgacgttcctggcggaagtactaccgccccttttttaaccgaaccttctcgggatcaggttgatgcctcgtttgaggtccaaaccgactacagccagtctacttccgtgtcgtttacctatgatggtgttggacttggtcctgccgagcgtgcggcttacgagaactggtgcgaaccgggccggcccacttggaaagatcttataatcaaggcacgtgtcgatccgattgacgatgtgacctggctccgagatttagaagaggacaccccctcaaccttcagatacgaagggatgcctctgggcatcggggaacgacaggcctacgaaaattggcaagaggacgctcagccgacatgggaagaccttgttgtcagcgcacgcttgacggaacttggccgtccacacgggattaccggcgagtatacatccctcgcaggatcgaagaatacaagttcaatttcattgaagcgaaagcggagcaacttaattgatgatgagaattcatccggatcgttttcatatgacgggatgaagctcggggaagccgagcgttctgcatatggtgactgggccgaggcggagccacccacgtggaaagatttggtattgagggcacgcgtttcctcgatcaatgactctgcttggctttttgattcacaaacatcttcatcatcatttgaatacaacggtgttcccttgggcgagccggaacggcaggctctcagacaatggcaaggagacgctcagcctacctgggaagatctcgttgttaacgcgcgtatggcagaactttgccatgctggttggattgaaggtcaaaaaggttgctttgaagagcgcggggaggctctgcccgcgtcggaacgcggttcgcaacgccccattggtcaacggacagattcctccgattcttttgtgtatgatggcacaaggctcggagcacctgagcgaactgcttatgaacgctggagtaagagggaacgcccgacttgggaagatctcatcttagatgcacaccaggccaggactgaaagtgacgctgttacgacccaagcgattggtcagtcgtcctcaccggttttcttatatgaaggaaagtcgctcggagacagggaacgaaaggcttacgaaaaatggcggcagccagcccaaccgcgatggcaaaatcttgtagtgaacgctcgtctggcagaaatcgatccctcagcctggattgccgatgagcgcgatccgcttgatgatagcgacgcgcttggtcgcccgtcgtacacaagcttgacggatagatcagacgtccctttagacgatcaatcaatctatcgtcgttccgacctagtaagggagcaggtgccagaatcgtctcaaaggcaattcgcagcatgttcagaatctgaaacgaggcctgtgcaatggtttactgcttctgggtcagatgcaaacaatacggaaaatatcaccgccagcgatcccgtcgatcgcacgggtggagttaagcggctaggctccaaaagcgacagaaccgttacagcttctatccatgacgtgaattccagcacaaggcgactgttgcttaacgaatttggatcggaggctccgcgcccttcgccagaaaagactgttcgcttaagaagcgacaatattggcacctatgggagccggaaaaatgaacgagcgcggctcgcgaccgaaaccggtgcgtatgagtcggagcatattttcgggttcaaggctgtccacgatactgcgagagcgacgaaagagggccggcgtctcgaaaggcccatgcccgcctaccttgaggataaggggcttcatcgccaacatattggcaccgggagaggacggaccaaacttgtcgggcgcggatggccggatgacacaagctatcgctcggatcaaagggcaactctgtcggaccccgttgcgcgctcggaaggcgcgacggcctcaaatgggtatcaattgaaccaattgggttacgcgcaccaactcgctagcgatggcctgcaaagtgaatcgcccgatggtgttgccttgccaattcaagtggcaacaacgagctacaactatacagtgagccgcgatcctgtccttgttccgccggataaaaacgaagcccctcaattgctgcatcttggtccccgtggtcaaaccgaagctgttcttgcccgcgaaacagcattgactggaaaatggccgactctcgagcgtgagcagcaagtgtatcgcgagtttttggccttatatgacgtaaaaaaagatcttgaggccaaatcagtcggcgtaagacggaaaaaaaaagaagttatttctgcgttagaccgaactgcgcgcttgataagcacgtcgccttcgaaagctcgatccaaagcagagactgaaaaagccattgatgagctcgatgatcgacgagtttatgatccgcgtgatcgagctcaagacaaagcgtttaaacgctgataagtcgccaatatagtgatcatttgcagtattcgcatcgatcgctggttgatattctgccgctggtcgaccggctgctcgtcgccaaaaatgctcacagggatacgatggcctcggtcaggccgcgtgcgtcctgtctttccagttcctccctttcagctcgattgtggcatcatttattgcctgctcattgcagttgaaacgcgatatccgtttcaagacccgggtatggatggtactttggagatatgagcacttgccagacttcccggtcggagacttaaaaattccgataagaggttacggacgacggaccttataagtggatcgtctagtggtggcgccgatcaaaacagttccgcccccggctttgctcaaagtagcaaagcagctttatctcgggttgcggaggattttctagaaaaccgcaattttgcaggagagaacatatggccatcatcaagccgcatgtgaacaaaaataggacaacctcgccgatagagagaccggagtctctcatagaggaaatgagcggcagtcatccgccgagtggttttaccaacctggatctcgctatgatcgagctggaggactttgtccatcggtgcccgctcccagaagacaatcttgctggtcagaaggagtgagacgatggatccgtctagcaatgagaatgtctatgtgggtcgcggtcacaacatcgaaaatgatgatgacactgaccccaggcgttggaagaaggcgaatatcagttccaacaccatctccgatattcagatgacgaatggcgaagacgtacaatcagggagccctacccgaacggaagttgtaagcccacgtctggattatggatcggtcgactcctcctccagcctttattctggcagcgagcacggaaatcaagctgagattcaaaaagagctgtccgtcttgttctcgaacatgtctttgccaggcaacgatcggcgcccggacgaatacattctcgtgcatcaaacgggacaagatgcttttactggtattgccaaaggcaacctcgaccaaatgcccaccaaggcggaatttaacgcgtgctgccgtctctacagggacggagccggtaattactacccgccacctctcgcattcgacaagattagcgttccagagcaactggaggaaaaatgggggatgatggaggcgaaggaacgtaacaaactgcggtttcagtacaagttggacgtatggaatcatgcgcacgctgatatggggatcacgggcacagagatcttttatcaaacagataagaacataaagctcgaccggaattataaactaagacctgaagaccgatacgtacaaacagaaaaatacgggcgccgggaaattcaaaagcgatatcaacacgaactccaggctggttcgctgctgcccgatattatgatcaaaactccccaaaatgacatccacttcgtgtacaggtttgccggcgacaattacgccaacaaacagttcagcgagtttgaacacaccgtcaagcgcaggtatggcgacgagactgagatcaaattgaagtcaaagtcaggcattatgcatgactcgaaatatctggaatcctgggaacggggcagtgcggatattcgcttcgcggaattcgttggggaaaatagagctcacaatcggcagtttccaactgcgacagtaaatatgggacagcagccagacgggcagggcggtttgacccgcgaccgtcatgtgagcgttgacttcctaatgcaaagcgcacccaattcgccttgggcgcaagctttgaaaaagggagaactgtgggatcgcgttcagttgcttgctcgcgacggcaaccgctatctgtcgccgcccagattggaatattctgaccctgcacatttcaccgagttgatgaaccgggttggtttacccgcatcgatgggtcggcaaagccatgcggctagtatcaaattcgaaaagtttgacgcgcaggcagcggttattgtcttaaatggcccagagttacgtgacattcatgacttgtctcctgaaaaactgcaaaatttgtccaccaaagatgtcatcgtcgccgatcgcaatgagaatggtcagagaactggcacgtacaccagcgtcgcggaatatgagcgcttgcagttaaggctgccacccgatgcagcgggggtgcttggtgaagcaactgacaaatattcacgtgatttcgttcggccagagccggcgtcgcgtccaatcagtgacagccgcaggatatacgaaagtcgaccgcgtagccaaagcgtcaacagcttttgacgttcctgctgccgcgtcaacgaggaagctcgtttgacccgggtttgccaatgaaagggctcaatcatggtgaacactacaaagaaaagttttgcgaagtcgcttacggcagatatgcgccgttctgctcagcgcgttgtcgagcaaatgcgaaaagcattgattaccgaagaagaggcgctcaagcggcaagccagactggagagtcccgataggaagcgaaagtatgctgctgatatggcgatagtcgacaaactcgacgtagggtttcgaggcgaaataggctataaaattcttggaaataaccggcttcgagtagacaaccataaagaattaacgcgtgagcacggtagacttcgcaaaaccaaaacggttctgaagcgtaacccggtgacgcaggaagtctatttgggtttatatgaaaggaagtcctggttaagtgtcagcagccatttgtatgctgcggacggcacactccgcatgaagcacgtgaaatacaaagacggacgttttgaggaaaaatgggagcgcgacgaaaatggcgacctgatccgcacaaggtacgccaaccgtggcaggctctttcaacctgtatccgagaaaatgggcgcgccgtatcggagcggccctgacgaccggctctatcgcgatctaacccgtcgaaacggtttcagacgggagacattcgaacgggacgatcacggaaacctcgagcgtatcggcagcaaccatgtcggcttttccaagatttcagtgaaggcacccaatcgtcaaacctcccagacgaagattcaaaaacttggtggcgctttcaacaaatcttttaggtcccttctggacaaggagggcaatgaaatgggccgcgatattttgagccatcgacggctctataacaagcggtctgctgtctacgatgaagctaccggacaattgaagagtgccaagcataccttcggcaagatctacaggagcgaaaccgaatatctcagcgcgggcctcaagaaggtttcaaaaaagatactcggggtgacggtctaccggaaatttgcggcgctcagcgagcgagaatccgaggctgagagactgcgtagttttgaatccggtgcgcatcgccagatctggcaggagcgggcagcgattcccggttcgcccctcccggagactgatgacattcatttcgcacagcagtcgcacctagccaaagccaaccctgatcacgtcgaagctgacgtcacgcgtgtgacagatcaacatgttgatgttgctggacaaacatcatcgtctccccaacggaacttggaaggatggttagattctcaatcacgatacaagccagcaaacatgctgttgtcaaatccagaccttcaagcgaacggacctcgcccatacgaagggttagctcatctcaccctccggcgcgataatgaatctgacgggcacaaggagaatgatcagcggctgcgacatttctcccagccagagccgttggtgttaccgcatcccgggtcgccggaaataactaaggtgtttggctcgcggggagagccggcacacccgagtggaaatctgcacacggcggttggagaaacggcttgcgaaggaccggtgatgtcttcatcctcggacaatcatcagccagctccaggacagcaagaacttttaagtttccttcataatgcgccagccccagtttctgtggcaatacatgatgatcaagagcgacttgcgggggaggcgcccggcggctctttcagaggtagctcagggcgaacgagttcaatgtcggagagtatcttcgacgaagatgtacaagggcatttggtacgggattattcgatcaatactactaacgggtttattgacccgcaatcgttgttcggtgaaccggacttatcgagaggtccaaaatcggggccagaaattccatcggaagattaccatttgtcagcttcggaacaggaaaatttgctgaatcaattgcttagtgtgccactgccggttccttcaccgaagcccgaatgcgcgaggtctatgattttcgaaggttcacgttcaagagagcgttccacctccagagggttctaaggtggaacgcgtctaggcttgcctatcatcaccacctcatgatggtcgcggagaccttcgaagagatatccgacatcattggagaagctgggccggaaactagtgtacctcgcgaatgcatctagatccaatccaatatgcatggcatgccgaatccatgtgggagtttattcttgacacagatatttatgatataataactgagtaagcttaacataaggaggaaaaacatatgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaagtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaataatgtctaacaattcgttcaagccgacgccgcttcgcggcgcggcttaactcaagcgttagatgcactatacgtaccaatccaaatcggatccccctgcagggctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatctatcgatggtacctatctgcagacggaagggattcctgttaattaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatgcatataattgtggtttcaaaatcggctccgtcgatactatgttatacgccaactctgaaaacaactttgaaaaagctgttttctggtattt

SEQ ID NO: 185 - DNA, 8903 bp, Artificial Sequence
  RV038288
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgagctcggtacggccagaatggcccggaccgggttaccaagcggccgcatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagcaacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgaccgtcgacccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccagggcccggtgaccaatcgaattcttagacgcgactgctgacaaccctagctagaaacaccctgaacactagttaggttttcctctgttatctgcgttgtcgatgtagttttctttatctcgagcaccgatgtgcatctgtgatcgggagatcatgtctctggaaactgttgtcttcgagatcctgtattaggagaaggaaaataaggtttttgagaagcgtattcacatgactactcacgttttccttgccatcgaccacgtcgtcgaccctgctagcttccacgttgtcattcagtatgttcgatcgcatcatctgatctaatcttataatgcagttcatctgttatggtagaagtgtgtcgcattcttataattagcatgttagggttacatgttaggtaacagacaccgagattatctctgtacaccattgttgccttcattgcctacgtcgtctctcacagccacaggtgtctgaatcatgaccctctttttaggagtagtctgtagagatgtgaggtaaagcagctttgcacgagaacgccaatctcgcgtgtttccgagtattttactgctccatttgtgggctacgcctgttgtttccgccacggatgtcggctgctcatcaccaaaaatatgactactttgaagttctggtagcagagtgggcccagacgccgttgcttgattctggctgggccaggctacgtgaggccttcttattagatcatttccgctgaaaggccgaaacgtgagagcctggcaaacttttctagaaaaaaaaaattcgcaaacaaaattttttccgaacaaacgctacaccagtgaccgccgtccgtcgtcgttgcttggctctccctttacttcggctccaacgccaatgcacaaccgtccctcttcgccatgtcccagttttgacgctgcctgtagcgcagtataaaaaatcgtctcgatgctcttgctcggtactccaattcacaccaaaacatagagtgtcgacttttctattggtgtgattgggggcactaaatacctaccacattgcactcagactacatatactgtgtttgtgtgttgtaagccgtaagcgtgtgtgagcttgcgcaaattggacatctaggccgtgcgtaccctgcgcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgaagccgaggccggccacactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcccggcggatctcgactctagaggatcgctcaggaaggccgctgagatagagccatggggaggagggcgtgttgcgcgaaggaaggcgttaagagaggggcgtggacgagcaaggaggacgatgccttggccgcctacgtcaaggcccacggcgaaggcaaatggagggaagtgccccagaaagccggtttgcgtcggtgcggcaagagctgccggctgcggtggctgaactacctccggcccaacatcaggcgcggcaacatctcctacgacgaggaggatctcatcatccgcctccacaggctcctcggcaacaggtggtcgctgattgcaggcaggctgcctggccgaacagacaatgaaatcaagaactactggaacagcacgctgggccggagggcaggcgccggcgccggcgccggcggcagatccacgatggcgctttcagcttcccgagttcagcaggcggaagaactgctgcaacgacctgctgagaggcagctgatgaggagccagcttgctgcagccgccaggagcatcaactggagctacgccctcttctggtccatttcagacactcaaccaggggtgctgacgtggacggacgggttctacaacggcgaggtgaagacgcggaagatttccaactccgtggagctgacatccgaccagctcgtcatgcagaggagcgaccagctccgggagctctacgaggccctcctgtcgggcgagggcgaccgccgcgctgcgcctgcgcggccggccggctctctgtcgccggaggacctcggcgacaccgagtggtactacgtggtgtccatgacctacgccttccggccaggccaagggttgcccggcaggagtttcgcgagcgacgagcatgtctggctgtgcaacgcgcacctcgccggcagcaaagccttcccccgcgcgctcctcgccaagagcgcgtccattcagtcaatcctctgcatcccggttatgggcggcgtgcttgagcttggtacaactgacacggtgccggaggccccggacttggtcagccgagcaaccgcggctttctgggagccgcagtgcccgagctccagcccgtcaggacgagcaaacgagacgggcgaggccgcagcagacgacggcacgtttgcgttcgaggaactcgaccacaataatggcatggacgacatagaggcgatgaccgccgccgggggacacgggcaggaggaggagctaagactaagagaagccgaggccctgtcagacgacgcaagcctggagcacatcaccaaggagatcgaggagttctacagcctctgcgacgaaatggacctgcaggcgctaccactaccgctagaggacggctggaccgtggacgcgtccaatttcgaggtcccctgctcttccccgcagccagcgccgcctccggtggatagggctaccgctaacgtcgccgccgacgcctcaagggcacccgtctacggctctcgcgcgacgagtttcatggcttggacgaggtcctcgcagcagtcgtcgtgctccgacgacgcggcgcccgcagcagtagtgccggccatcgaggagccgcagagattgctgaagaaagtggtggccggcggcggtgcttgggagagctgtggcggcgcgacgggagcagcacaggaaatgagtggcactggcaccaagaaccacgtcatgtcggagcgaaagcgacgagagaagctcaacgagatgttcctcgtcctcaagtcactgcttccgtccattcacagggtgaacaaagcgtcgatcctcgccgaaacgatagcctacctcaaggagcttcagagaagggtgcaagagctggagtccagtagggaacctgcgtcgcgcccatccgaaacgacgacaaggctaataacaaggccctcccgtggcaataatgagagtgtgaggaaggaggtctgcgcgggctccaagaggaagagcccagagctcggcagagacgacgtggagcgccccccggtcctcacgatggacgccggcaccagcaacgtcaccgtcaccgtctcggacaaggatgtgctcctggaggtgcagtgccggtgggaggagctcctgatgacgcgagtgttcgacgccatcaagagcctccatttggacgtcctctcggttcaggcttcagcgccagatggcttcatggggcttaagatacgagctcagtttgctggctccggtgccgtcgtgccctggatgatcagcgaggctcttcgcaaagctatagggaacccctgggtcgtcgtcgcgccggacaccggctcgcacgccaccccggccgcgacgtcgggcgcctgcgagacgggccagaatagcgccgctcatcgcgcggaccccgactcagccgggacgacgacgacctcggcggcggcggtgtgggcgcccaaggccgtgcggtgcacgggcggactcttcttcttccaccgggacacgacgccggcgcacgcgggcgagacggcgacgccaatggccggtggaggtggaggaggaggaggagaagcagggtcgtcggacgactgcagctcggcggcgtcggtatcgcttcgcgtcggaagccacgacgagccgtgcttctccggcgacggtgacggcgactggatggacgacgtgagggccctggcgtcgtttctggagtccgacgaggactggctccgctgtcagacggccgggcagcttgcgtagtggccaggtaccactaactatctatactgtaataatgttgtatagccgccggatagctagctagtttagtcattcagcggcgatgggtaataataaagtgtcatccatccatcaccatgcgtggcaacgtgagcaatgacctgattgaacaaattgaaatgaaaagaagaaatatgttatatgtcaacgagatttcctcataatgccactgacgacgtgtgtccaagaaatgtatcagtgatacgtatattcacaatttttttatgacttatactcacaatttgtttttttactacttatactcacaatttgttgtgcgtaccataacaatttcgatcgaatatatatcagaaagttgacgaaagtaagctcactcaaaaagttaaatgggctgcggaagctgcgtcaggcccaagttttggctattctatccggtatccacgattttgatggctgagggacatatgttcgcttaagcttggcgcgccggtcacccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 186 - DNA, 8874 bp, Artificial Sequence
  RV022820
aacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgagctcggtacggccagaatggcccggaccgggttaccaagcggccgcatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagcaacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgaccgtcgacccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccagggcccggtgaccaatcgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaaacaacgtaagcgcttacgcaccgaacaacgtaagcgcttacgcaccgaacaacgtaagcgcttacgcacccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgaagccgaggccggccacactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcccggcggatctcgactctagaggatcgctcaggaaggccgctgagatagagccatggggaggagggcgtgttgcgcgaaggaaggcgttaagagaggggcgtggacgagcaaggaggacgatgccttggccgcctacgtcaaggcccacggcgaaggcaaatggagggaagtgccccagaaagccggtttgcgtcggtgcggcaagagctgccggctgcggtggctgaactacctccggcccaacatcaggcgcggcaacatctcctacgacgaggaggatctcatcatccgcctccacaggctcctcggcaacaggtggtcgctgattgcaggcaggctgcctggccgaacagacaatgaaatcaagaactactggaacagcacgctgggccggagggcaggcgccggcgccggcgccggcggcagatccacgatggcgctttcagcttcccgagttcagcaggcggaagaactgctgcaacgacctgctgagaggcagctgatgaggagccagcttgctgcagccgccaggagcatcaactggagctacgccctcttctggtccatttcagacactcaaccaggggtgctgacgtggacggacgggttctacaacggcgaggtgaagacgcggaagatttccaactccgtggagctgacatccgaccagctcgtcatgcagaggagcgaccagctccgggagctctacgaggccctcctgtcgggcgagggcgaccgccgcgctgcgcctgcgcggccggccggctctctgtcgccggaggacctcggcgacaccgagtggtactacgtggtgtccatgacctacgccttccggccaggccaagggttgcccggcaggagtttcgcgagcgacgagcatgtctggctgtgcaacgcgcacctcgccggcagcaaagccttcccccgcgcgctcctcgccaagagcgcgtccattcagtcaatcctctgcatcccggttatgggcggcgtgcttgagcttggtacaactgacacggtgccggaggccccggacttggtcagccgagcaaccgcggctttctgggagccgcagtgcccgagctccagcccgtcaggacgagcaaacgagacgggcgaggccgcagcagacgacggcacgtttgcgttcgaggaactcgaccacaataatggcatggacgacatagaggcgatgaccgccgccgggggacacgggcaggaggaggagctaagactaagagaagccgaggccctgtcagacgacgcaagcctggagcacatcaccaaggagatcgaggagttctacagcctctgcgacgaaatggacctgcaggcgctaccactaccgctagaggacggctggaccgtggacgcgtccaatttcgaggtcccctgctcttccccgcagccagcgccgcctccggtggatagggctaccgctaacgtcgccgccgacgcctcaagggcacccgtctacggctctcgcgcgacgagtttcatggcttggacgaggtcctcgcagcagtcgtcgtgctccgacgacgcggcgcccgcagcagtagtgccggccatcgaggagccgcagagattgctgaagaaagtggtggccggcggcggtgcttgggagagctgtggcggcgcgacgggagcagcacaggaaatgagtggcactggcaccaagaaccacgtcatgtcggagcgaaagcgacgagagaagctcaacgagatgttcctcgtcctcaagtcactgcttccgtccattcacagggtgaacaaagcgtcgatcctcgccgaaacgatagcctacctcaaggagcttcagagaagggtgcaagagctggagtccagtagggaacctgcgtcgcgcccatccgaaacgacgacaaggctaataacaaggccctcccgtggcaataatgagagtgtgaggaaggaggtctgcgcgggctccaagaggaagagcccagagctcggcagagacgacgtggagcgccccccggtcctcacgatggacgccggcaccagcaacgtcaccgtcaccgtctcggacaaggatgtgctcctggaggtgcagtgccggtgggaggagctcctgatgacgcgagtgttcgacgccatcaagagcctccatttggacgtcctctcggttcaggcttcagcgccagatggcttcatggggcttaagatacgagctcagtttgctggctccggtgccgtcgtgccctggatgatcagcgaggctcttcgcaaagctatagggaacccctgggtcgtcgtcgcgccggacaccggctcgcacgccaccccggccgcgacgtcgggcgcctgcgagacgggccagaatagcgccgctcatcgcgcggaccccgactcagccgggacgacgacgacctcggcggcggcggtgtgggcgcccaaggccgtgcggtgcacgggcggactcttcttcttccaccgggacacgacgccggcgcacgcgggcgagacggcgacgccaatggccggtggaggtggaggaggaggaggagaagcagggtcgtcggacgactgcagctcggcggcgtcggtatcgcttcgcgtcggaagccacgacgagccgtgcttctccggcgacggtgacggcgactggatggacgacgtgagggccctggcgtcgtttctggagtccgacgaggactggctccgctgtcagacggccgggcagcttgcgtagtggccaggtaccactaactatctatactgtaataatgttgtatagccgccggatagctagctagtttagtcattcagcggcgatgggtaataataaagtgtcatccatccatcaccatgcgtggcaacgtgagcaatgacctgattgaacaaattgaaatgaaaagaagaaatatgttatatgtcaacgagatttcctcataatgccactgacgacgtgtgtccaagaaatgtatcagtgatacgtatattcacaatttttttatgacttatactcacaatttgtttttttactacttatactcacaatttgttgtgcgtaccataacaatttcgatcgaatatatatcagaaagttgacgaaagtaagctcactcaaaaagttaaatgggctgcggaagctgcgtcaggcccaagttttggctattctatccggtatccacgattttgatggctgagggacatatgttcgcttaagcttggcgcgccggtcacccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaattt

SEQ ID NO: 187 - DNA, 8437 bp, Artificial Sequence
  RV006010
aacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgagctcggtacggccagaatggcccggaccgggttaccaagcggccgcatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagcaacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgaccgtcgacccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccagggcccggtgaccaatcgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatgtatggcaccgaagaagaagcgcaaggtgatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgggtggaggcggctccggtggcggaggctccggaggcggtggctccccgaaggcggcaaatgacgtggatcggctgacacgggattttgacgagcgcatccgcgtccgcggggatggacgtggactctaaggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaattt

SEQ ID NO: 188 - DNA, 8737 bp, Artificial Sequence
  PHP91522
aacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgagctcggtacggccagaatggcccggaccgggttaccaagcggccgcatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagcaacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgaccgtcgacccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccagggcccggtgaccaatcgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatgtatggcaccgaagaagaagcgcaaggtgatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgggtggaggcggctccggtggcggaggctccggaggcggtggctccctcaaaatcctctcgcgaaacgcgaaattgttgtctcatgccgtgcggcacgcagcaacacttccagatggagaacaattaagtgaagcgcaactgtcgcaaatgcgaagtgaagtcgctactcgcccagtcctgggcgtagcgtatacccatcaagacggtcaaccagaagagaggttgtcagggaaccacttggaccataaaatcaacaatatccctaacttggtcttcaacgttgcggaaccgattatgttcaatgaaatctccgctctcgaggttatggcagaagttcggcccatagcccgatccattaaaacggctcacgacgatgcgcgagcggaattaatgtcggcggacagacctcgatcaacgcgcggtctatgaggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaattt

SEQ ID NO: 189 - DNA, 20515 bp, Artificial Sequence
  PHP90308
aacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggcctccggaatttatcgctatcaactttgtatagaaaagttgggccgaattcgagctcggtacggccagaatggcccggaccgggttaccgaattcgagctcggtaccctgggatccggtgcgggcctcttcgctattacgccagctggcgaaagggggatgtgctgcaaggcgattaagttgggtaacgccagggttttcccagtcacgacgttgtaaaacgacggccagtgccaagctcagatcagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccggtcgccaccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgctgatccgatatcgatgggccctggccgaagcttggtcacccggtccgggcctagaaggccagcttcaagtttgtacaaaaaagcaggctccggccagaatggcccggaccgggttaccgaattcgagctcggtaccctgggatccgatatcgatgggccctggccgaagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgtgatgcatccggacggggttttagagctagaaatagcaagttaaaataaggctagtccgttatcaacttgaaaaagtggcaccgagtcggtgctttttttttgcggccgcgaattcctgcagggccctcttgtcggaccagttgcccaccacgttggtgaggggcacccagctttcttgtacaaagtggccgttaacggatcggccagaatggcccggaccgggttaccgaattcgagctcggtaccctgggatccgatatcgatgggccctggccgaagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaaggggcttcggaggatgttttagagctagaaatagcaagttaaaataaggctagtccgttatcaacttgaaaaagtggcaccgagtcggtgctttttttttgcggccgcgaattcctgcagggccctcttgtcggaccagttgcccaccacgttggtgaggggcaactttattatacaaagttgatagataatacgcgtctatagtattttaaaattgcattaacaaacatgtcctaattggtactcctgagatactataccctcctgttttaaaatagttggcattatcgaattatcattttactttttaatgttttctcttcttttaatatattttatgaattttaatgtattttaaaatgttatgcagttcgctctggacttttctgctgcgcctacacttgggtgtactgggcctaaattcagcctgaccgaccgcctgcattgaataatggatgagcaccggtaaaatccgcgtacccaactttcgagaagaaccgagacgtggcgggccgggccaccgacgcacggcaccagcgactgcacacgtcccgccggcgtacgtgtacgtgctgttccctcactggccgcccaatccactcatgcatgcccacgtacacccctgccgtggcgcgcccagatcctaatcctttcgccgttctgcacttctgctgcctataaatggcggcatcgaccgtcacctgcttcaccaccggcgagccacatcgagaacacgatcgagcacacaagcacgaagactcgtttaggagaaaccacaaaccaccaagccgtgcaagcaccaggcttgggcacccgctccgggcttagaaggccagcttcaagtttgtacaaaaaagcaggcttcgaaggagatagaaccgatccaccatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggcctaaggggtcaccggcctagaaggccatttaaatcagatatctggttcctaaggacccggcggaccgattaaactgattcggtccgacgcgttacctaataacttcgtatagcatacattatacgaagttattagctaactaactagtaagcttaagccatgggtcgacggatccgttaactcacttaagatgtactcgacaatggtgccctcataccggcatgtgtttcctagaaataatcaatatattgattgagatttatctcgatatatttctgaactatgttcatcatataaataactgaaaacatcaaatcgtaattttaaactcatgcttggtcaatacatagataatacaatattacttcatcatcccaatgatgtcctagcacaacctattgaatgttaatgtttggttgtgtgggggtgtgtttataacatagatgtgattatttgtgctttttgttgagtatatacatatatggtatgttgatttgatatagtgatggacacatgctttggccttggatattcaaatcacttgtacttgcacgaagcaaaacataatataagtttagaagtaaacttgtaactgtgtccaaacatgctcacacaaagtcatatcgcattatatttttttggtaaatattcaacacatgtattttttacaagaacccaaattttacagacaaatgcagcattgtagacatgtagaattctttgaagcatgtgaacttaacaacactaatgtcattaaatcaactggaccctatgagtaacaatttcgatattgcaaacaccaaattatggaacttatttgctgaaaaaattatgatcaatgtgaagtttaaattattataccataaatatatcaaagattttttttgaggaaggtaaaaattgcatggaatgggctgcccaacgtgatagctcacttttatgctaggtagcattaccaaagatgggaatgttctgatgaacaccaaacccactcaaataatatttatatttgggttgtttagttgtaaaagtgaagacccaagattaaagtaccaattgtcgatgccatacactagaagtgaagaatgttgttagcgttaggagtagatgtgtcaatggggaccgatactcgttatcgatgggccgcacgtaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagggcgatccgatatcgatgggccctggccgaagcttggtcacccggtccgggcctagaaggccagcttcggccgccccaattcccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactaagctgaccgaagctggccgctctagaactagtggatctcgatgtgtagtctacgagaagggttaaccgtctcttcgtgagaataaccgtggcctaaaaataagccgatgaggataaataaaatgtggtggtacagtacttcaagaggtttactcatcaagaggatgcttttccgatgagctctagtagtacatcggacctcacatacctccattgtggtgaaatattttgtgctcatttagtgatgggtaaattttgtttatgtcactctaggttttgacatttcagttttgccactcttaggttttgacaaataatttccattccgcggcaaaagcaaaacaattttattttacttttaccactcttagctttcacaatgtatcacaaatgccactctagaaattctgtttatgccacagaatgtgaaaaaaaacactcacttatttgaagccaaggtgttcatggcatggaaatgtgacataaagtaacgttcgtgtataagaaaaaattgtactcctcgtaacaagagacggaaacatcatgagacaatcgcgtttggaaggctttgcatcacctttggatgatgcgcatgaatggagtcgtctgcttgctagccttcgcctaccgcccactgagtccgggcggcaactaccatcggcgaacgacccagctgacctctaccgaccggacttgaatgcgctaccttcgtcagcgacgatggccgcgtacgctggcgacgtgcccccgcatgcatggcggcacatggcgagctcagaccgtgcgtggctggctacaaatacgtaccccgtgagtgccctagctagaaacttacacctgcaactgcgagagcgagcgtgtgagtgtagccgagtagatcccccgggctgcaggtcgactctagaggatccaccggtcgccaccatggccctgtccaacaagttcatcggcgacgacatgaagatgacctaccacatggacggctgcgtgaacggccactacttcaccgtgaagggcgagggcagcggcaagccctacgagggcacccagacctccaccttcaaggtgaccatggccaacggcggccccctggccttctccttcgacatcctgtccaccgtgttcatgtacggcaaccgctgcttcaccgcctaccccaccagcatgcccgactacttcaagcaggccttccccgacggcatgtcctacgagagaaccttcacctacgaggacggcggcgtggccaccgccagctgggagatcagcctgaagggcaactgcttcgagcacaagtccaccttccacggcgtgaacttccccgccgacggccccgtgatggccaagaagaccaccggctgggacccctccttcgagaagatgaccgtgtgcgacggcatcttgaagggcgacgtgaccgccttcctgatgctgcagggcggcggcaactacagatgccagttccacacctcctacaagaccaagaagcccgtgaccatgccccccaaccacgtggtggagcaccgcatcgccagaaccgacctggacaagggcggcaacagcgtgcagctgaccgagcacgccgtggcccacatcacctccgtggtgcccttctgaagcggcccatggatattcgaacgcgtcgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagccagggtgcttcctgagctgattccgatgacttcgtaggttcctagctcaagccgctcgtgtccaagcgtcacttacgattagctaatgattacggcatctaggaccgactagctaactaactagtacgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaattt

SEQ ID NO: 190 - DNA, 17794 bp, Artificial Sequence
  PHP90670
gtcagcatcatcacaccaaaagttaggcccgaatagtttgaaattagaaagctcgcaattgaggtctacaggccaaattcgctcttagccgtacaatattactcaccagatcctaaccggtgtgatcatgggccgcgattaaaaatctcaattatatttggtctaatttagtttggtattgagtaaaacaaattcggcgccatgcccggccatgcccgggtagggataacagggtaatagatggttcctgtgtgaggcggccgcctcgaggctggctagtcacgactcatggccaaaagtgaagagtcaagacagctttggcattttgtcatgaaatttctctaaccaagactggcaagaatgtgtatgtgtgttctccaatgatttggtgaacagatttaagaaccttgttaccgtatctacctcagctggtgtgatcaagttgctgtcatgcattgcatgccactgcctccaggaaacataaagctttcataagaattatgatcacagataatttatccttgtaaaaaaaacctagctaacatagtaataacctggatcacttatcactcaaataaataatatgaatctgagctatactacgagaacttctggattcagcaagaactagcagcaatcagaacccaatagcatagcaacaaaccgaacaatcaaccatatattaggagacggtagatagaaccacgttaacattaagggggtgtttgaatgcactgaaactaattgttagttggctaaaaattgttagttgaattagctagctaacaaataactacctcactattaactaattttccaaaaatagctaatagttcaactattagctatggtgtttggatgttttaactaattttagccactaactattagttttagtgcattcaaacacctcctaagtaagaaacggtagatagccagtacctgcaggcaaatattaggagacaactgaaagacagaacataatgagcacaggctttaatttcaaacatcaaacttattcatgatttgtcatagttctgggtagtacgcacacacaacacaaccggtccattattaaaccaacactgacacgactcatgacacgaacagcagatactttgacaacctccatatggagagagggcaccagacgacgcaggcacatcggcagcttaaacgacccatgacctaggtgattaagctaactacttagaagttgatctcgccgttattgaatttcctgcggacctcttccagcgtcagggtgccggccttgatcatctccccgccaatgagcagttcctcgacggagagcacagcgccattgcagttggtcttcctgttgaggcgcgtcagctgcgccttgtagttacccttgaaatgcccggagacaaacaggaatttgaactcggtcacggagcttggatacaccttccaccactcattcgggttaatgtgcttgttcctggtttggttttccttgacgtagcgctgcatctcatcggcctggccgattgggagattgtacccgccgctgtaagccttcgtgtcgacgatcacgccataatcgatcggggaacccacggtgtagatcgcgccgtctggcttcctgctaccccccaggtgtttgccgcgatagccgtacaccttcataaagaactccatgaccttcatttcgagaatcctgtcttgggtggagttgcgggcaatctcgatcagctcgatgtactcatgcgggacgtacttgagcttgtgcctgagttcgcttttcttctcttccagctccctggcagcggcctcgctcttgctcttgaccagctgggatccggatccccgcaggccgccgcagcgctgggcatggcgggccaggttgccggactgggcaaacttcctcccacaaatgtcacaggcaaaaggcttctcgcctgtgtgggtgcggatgtgctcggacagcacgtcggagcgactgaagttacgcatgcagattcgacactggaagggcttctgagatcccgtgtgtatcttggtatggcgggtcagggagccggaggtggcaaacttcctcccacaaatgtcacaggcaaaaggcttctcgcctgtgtgggtgcggatgtggcgggtcaggttgccggaggtactgaagttacgcatgcagattcgacactggaacggccgttgtccgcccgtgtgtatcttggtatgcttcttgcggtcgtcgttgcgggcaaacttcctcccacaaatgtcacaggcaaaaggcttctcgcctgtgtgggtgcggatgtggcgggacagggcggagcggtcactgaagttacgcatgcagattcgacactggaagggcctctcagccatggcggcggggggtaccccgtggatgcccaccttcctgtacctggacctcctggcggactccctgttggactccttcctcttcctcggggccatcctagggccgggattctcctccacgtcaccgcatgttagaagacttcctctgccctctccgccgccagatctgaagttgatctcgccgttattgaatttcctgcggacctcttccagcgtcagggtgccggccttgatcatctccccgccaatgagcagttcctcgacggagagcacagcgccattgcagttggtgatgtggttgaggcgcgtcagctgcgccttgtagttacccttgaaatgcccggagacaaacaggaatttgaactcggtcacggagcttggatacaccttccaccactcattcgggttcaggtgcttgtccctggtttggttttcctcgacgtagcgctccatctcatcggcctggccgattgggagattgtacccgccgctgtaagccttcgtgtcgacgatcacgccataatcgatcggggaacccacggtgtagatcgcgccgtctggcttcctgctaccccccaggtgtttgccgcgatagccgtacaccttcataaagaactccatgaccttcatttcgagaatcctgtcttgggtggagttgcgggcaatctcgatcagctcgatgtactcatgcgggacgtacttgagcttgtgcctgagttcgcttttcttctcttccagctccctggcagcggcctcgctcttgctcttgaccagctgggatccggatccccgcaggccgccgcagcgctgggcatgctgggtcagggcgtcggagcgggcaaacttcctcccacaaatgtcacaggcaaaaggcttctcgcctgtgtgggtgcggatgtggcgggccagggtgccgcgctcactgaagttacgcatgcagattcgacactggaagggcttctgagatcccgtgtgtatcttggtatgctttttgcgggtggcgctctgggcaaatttccttccacaaatgtcacaggcaaaaggcttctcgcctgtgtgggtgcggatgtgttcgctcaggtggtcactacgactgaagttacgcatgcagattcgacactggaagggcctctcagccatagcggcggggggtaccccgtggatgcccaccttcctgtacctggacctcctggcggactccctgttggactccttcctcttcctcggggccatggtgtcgtgtacctgcagaagtaacaccaaacaacagggtgagcatcgacaaaagaaacagtaccaagcaaataaatagcgtatgaaggcagggctaaaaaaatccacatatagctgctgcatatgccatcatccaagtatatcaagatcgaaataattataaaacatacttgtttattataatagataggtactcaaggttagagcatatgaatagatgctgcatatgccatcatgtatatgcatcagtaaaacccacatcaacatgtatacctatcctagatcgatatttccatccatcttaaactcgtaactatgaagatgtatgacacacacatacagttccaaaattaataaatacaccaggtagtttgaaacagtattctactccgatctagaacgaatgaacgaccgcccaaccacaccacatcatcacaaccaagcgaacaaaaagcatctctgtatatgcatcagtaaaacccgcatcaacatgtatacctatcctagatcgatatttccatccatcatcttcaattcgtaactatgaatatgtatggcacacacatacagatccaaaattaataaatccaccaggtagtttgaaacagaattctactccgatctagaacgaccgcccaaccagaccacatcatcacaaccaagacaaaaaaaagcatgaaaagatgacccgacaaacaagtgcacggcatatattgaaataaaggaaaagggcaaaccaaaccctatgcaacgaaacaaaaaaaatcatgaaatcgatcccgtctgcggaacggctagagccatcccaggattccccaaagagaaacactggcaagttagcaatcagaacgtgtctgacgtacaggtcgcatccgtgtacgaacgctagcagcacggatctaacacaaacacggatctaacacaaacatgaacagaagtagaactaccgggccctaaccatgcatggaccggaacgccgatctagagaaggtagagagggggggggggggggaggacgagcggcgtaccttgaagcggaggtgccgacgggtggatttgggggagatctggttgtgtgtgtgtgcgctccgaacaacacgaggttggggaaagagggtgtggagggggtgtctatttattacggcgggcgaggaagggaaagcgaaggagcggtgggaaaggaatcccccgtagctgccggtgccgtgagaggaggaggaggccgcctgccgtgccggctcacgtctgccgctccgccacgcaatttctggatgccgacagcggagcaagtccaacggtggagcggaactctcgagaggggtccagaggcagcgacagagatgccgtgccgtctgcttcgcttggcccgacgcgacgctgctggttcgctggttggtgtccgttagactcgtcgacggcgtttaacaggctggcattatctactcgaaacaagaaaaatgtttccttagtttttttaatttcttaaagggtatttgtttaatttttagtcactttattttattctattttatatctaaactattaaataaaaaaactaaaatagagttttagttttcttaatttagaggctaaaatagaataaaatagatgtactaaaaaaattagtctataaaaaccattaaccctaaaccctaaatggatgtactaataaaatggatgaagtattatataggtgaagctatttgcaaaaaaaaaggagaacacatgcacactaaaaagataaaactgtagagtcctgttgtcaaaatactcaattgtcctttagaccatgtctaactgttcatttatatgattctctaaaacactgatattattgtagtactatagattatattattcgtagagtaaagtttaaatatatgtataaagatagataaactgcacttcaaacaagtgtgacaaaaaaaatatgtggtaattttttataacttagacatgcaatgctcattatctctagagaggggcacgaccgggtcacgctgcactcacctttgtcatgcggccgctccggataaattcatccgactcaggttattgtttggcggccgcaagctgtactgaagcttgccgagtgccatccttggacactcgataaagtatattttattttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgatttcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgatattgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacactacaccacaggtacctcttcctggagcaccagtgtccatggacgagagagcgagcgcgatggggaggagggcgtgttgcgcgaaggaaggcgttaagagaggggcgtggacgagcaaggaggacgatgccttggccgcctacgtcaaggcccatggcgaaggcaaatggagggaagtgccccagaaagccggtttgcgtcggtgcggcaagagctgccggctgcggtggctgaactacctccggcccaacatcaggcgcggcaacatctcctacgacgaggaggatctcatcatccgcctccacaggctcctcggcaacaggtggtcgctgattgcaggcaggctgcctggccgaacagacaatgaaatcaagaactactggaacagcacgctgggccggagggcaggcgccggcgccggcgccggcggcagctgggtcgtcgtcgcgccggacaccggctcgcacgccaccccggccgcgacgtcgggcgcctgcgagacgggccagaatagcgccgctcatcgcgcggaccccgactcagccgggacgacgacgacctcggcggcggcggtgtgggcgcccaaggccgtgcggtgcacgggcggactcttcttcttccaccgggacacgacgccggcgcacgcgggcgagacggcgacgccaatggccggtggaggtggaggaggaggaggagaagcagggtcgtcggacgactgcagctcggcggcgtcggtatcgcttcgcgtcggaagccacgacgagccgtgcttctccggcgacggtgacggcgactggatggacgacgtgagggccctggcgtcgtttctcgagtccgacgaggactggctccgctgtcagacggccgggcagcttgcgtaataatgagtagttagcttaatcacctagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgtagttccctcattcactagctgcggccgctgcgaagtagtcaagggtcgcggccgcgtgaagtcgattccttctgaagcttgccgagtgccatccttggacactcgataaagtatattttattttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgatttcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgatattgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacactacaccacaggtacctcttcctggagcaccagtgtccatgctgtggggccatatcccagaactggttgagtcggtcgtctcaccgcggcttggggattggatacggagctagttaaccagcagagctagatagcagacgcagatcgcttgcttctctggtttgatttttggagtcaccatttctgtttggttcgtgtgcctcagtgtctgacagcagcagatcctcgatggagatggatggggttctgcaagccgcggatgccaaggactgggtttacaagggggaaggcgccgcgaatctcatcctcagctacaccggcacgtcgccctccatggtaagcgctgagtaggttcttactgagtgtgcacgcatcgatcacttgactttaggggctcaatgtgtgattcacgggtgccgccattcgagctccagatccagtatcgctcgagcaagtgataaaacatggagcagggacgatcacgtggtcacttgaaaattatgtgaggtccggggcgacgatgtacggcgcggcgaactctcaaacactcacacagccaaaaccgcttcgtgttcgtctttgttccaagcgaccgtgtggtgtgtttgtagtagttcgccggcgccgcacatcgtcgccccggatctgacaaattaagctttcgttgcttttccacgattgtgcattttctgagcatgcactgaatactatgatggatatgtttggaggaagcattattccaatttgatgataatggtgttatttacacttgttttcagcttggcaaggtactgcggctcaagaagattctaaaaaacaagttgcagcgggcaccaagttgtattgccttctcaagtcatgagcaactcctgtggggccatatcagtagtggcggcggagagggcagaggaagtcttctaacatgcggtgacgtggaggagaatcccggccctaggatgcctggcaccgctgaggtgcaagtgaggcctggcgtggaggaggacctgaaaccgctgaccgacctgtacaaccactacgtgagggagactccgatcaccttcgacaccgagccgttcaccccagaggagaggaggccgtggctgctgtcccaccctgaggacggtccgtataggctgagggtggcgaccgacgctgagtcccaagagatcctgggctacgccacctcctctccgtacagagccaagccagcgtacgccacctccgtggagacgaccgtgtacgtggctcctggagctggtgggaggggaatcggcagcctgctgtacgcctccctgttcgacgcactcgcagccgaggacctgcacagagcgtacgctggaatagcgcagccgaacgaggcgtcagcgaggctgcacgcgaggttcggctttaggcacgtgggcacctacagagaggtgggcagaaagttcggacgctactgggacgtggcctggtacgagaggcctctgtaagtagttagcttaatcacctagggtcgcagcgtgtgcgtgtccgtcgtacgttctggccggccgggccttgggcgcgcgatcagaagcgttgcgttggcgtgtgtgtgcttctggtttgctttaattttaccaagtttgtttcaaggtggatcgcgtggtcaaggcccgtgtgctttaaagacccaccggcactggcagtgagtgttgctgcttgtgtaggctttggtacgtatgggctttatttgcttctggatgttgtgtactacttgggtttgttgaattattatgagcagttgcgtattgtaattcagctgggctacctggacattgttatgtattaataaatgctttgctttcttctaaagatctttaagtgcttagtctatattgagcggccgctatatgaatgcaatcgaacaatggttaaagcggccgcaaacaaaggcttacttgactagtccagaactggttgagtcggtcaaacaagattgcttggctcaagcctatgcagtgcatgttatgagccaacacctgggtgccaatcatgtcgatggtggggtatggttcagattcagttcatttatgtcctgttattgtgattttgattggtaacatattgacaacctcgacacttgggatcagattcagttcacttatggaagaaattggagaattgtgataatttatctataatcacccctactgaaatagaaataacatgacatcaatgtgcatgctattggattttgacacgaatatgctttattctatcatatgttggtaattccagcaggcagcaggcactactctttggatccacgtgacttgacaaagaaatcatgccatctttccacaatgcaggtccgtgtacgtgtttctagggattttctggagcttgtcgaaaagaatgttcttagcagccgtcctgctgggagagtaaatgcaagttcaattgataacactgctgatgccggtcttctaatagcagaccactctttattttctggtacgtactctatccctcttcttaccataatctgaatcttgttaaggtttaaaatatatgattgattaagtaaaatccagagctctattcatatctcacgcactgatgttttgatgaaacgcttgcagcaagacggttgcctgttatttctatttgcattagacaaacagtcacctttgtttataaaggtctttgaatttgcagttcttataggtttaagtttgcaactgttacttacaacagcccaatgggtagcatcaaggctgtggggccatatcccagaactggttgagtcggtcccgacgagacacctcaaggacccatttaaatcgttattagtaaggcgcgtgatggcgctctcagcttccccggctcaggaagaactgctgcagcctgctgggaggccgttgaggaagcagcttgctgcagccgcgaggagcatcaactggagctatgccctcttctggtccatttcaagcactcaacgacctcgggtgctgacgtggacggacgggttctacaatggcgaggtgaagacgcgtaagatctcccactccgtggagctgacagccgaccagctgctcatgcagaggagcgagcagctccgggagctctacgaggccctccggtccggcgagtgcgaccgccgcgcggcgcggccggtgggctcgctgtcgccggaggacctcggggacaccgagtggtactacgtgatctgcatgacctacgccttcctgccgggccaaggcttgcccggcaggagttccgcgagcaacgagcatgtctggctgtgcaacgcgcacctcgccggcagcaaggacttcccccgcgcgctcctggccaagagcgcgtccattcagacaatcgtctgcatcccgctcatgggtggcgtgcttgagcttggtactactgataaggtgccggaggacccggacttggtcagccgagcaaccgtagcattctgggagccgcaatgtccgacatactcgaaagagccgagctccaacccgtcagcatacgaaaccggggaagccgcatacatagtcgtgttggaggacctcgatcacaatgccatggacatggagacggtgactgccgccgccgggagacacggaaccggacaggagctaggagaagtcgagagcccgtcaaatgcaagcctggagcacatcaccaaggggatcgacgagttctacagcctctgcgaggaaatggacgtgcagccgctagaggatgcctggataatggacgggtctaatttcgaagtcccgtcgtcagcgctcccggtggatggctcaagcgcacccgctgatggttctcgcgcgacaagtttcgtggtttggacgaggtcatcgcactcctgctcgggtgaagcggcggcggtgccggtcatcgaggagccgcagaaattgctgaagaaagcgttggccggcggcggtgcttgggcgaacacgaactgcggtggcgggggcacgacggtaacagcccaggaaaacggcgccaagaaccacgtcatgtcagagcgaaagcgccgggagaagctcaacgagatgttcctcgttctcaagtcgttggttccctccattcacaaggtggacaaagcatccatcctcgccgaaacgatagcctatctaaaggagcttcaacgaagggtacaagaactggaatccaggaggcaaggtggcagtgggtgtgtcagcaagaaagtctgtgtgggctccaactccaagaggaagagtccagagttcgccggtggcgcgaaggagcacccctgggtcctccccatggacggcaccagcaacgtcaccgtcaccgtctcggacacgaacgtgctcctggaggtgcaatgccggtgggagaagctcctgatgacacgggtgttcgacgccatcaagagcctccatttggacgctctctcggttcaggcttcggcaccagatggcttcatgaggctcaagataggagctcagtttgcaggctccggcgccgtcgtgcccggaatgatcagccaatctcttcgtaaagctatagggaagcgataataatgagtagttagcttaatcacctagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgtagtagaagagggcacttaagcggccgcaattaggagcgtgtgcagactggaacgcccatgcggccgcctaactgagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcaggtacacgacaccatggctcatgctgccctcagccctctctcccaacgctttgagagaatagctgtccagccactcactggtgtccttggtgctgagatcactggagtggacttgagggaaccacttgatgacagcacctggaatgagatattggatgccttccacacttaccaagtcatctactttcctggccaagcaatcaccaatgagcagcacattgcattctcaagaaggtttggaccagttgatccagtgcctcttctcaagagcattgaaggctatccagaggttcagatgatccgcagagaagccaatgagtctggaagggtgattggtgatgactggcacacagactccactttccttgatgcacctccagctgctgttgtgatgagggccatagatgttcctgagcatggcggagacactgggttcctttcaatgtacacagcttgggagacgttgtctccaaccatgcaagccaccatcgaagggctcaacgttgtgcactctgccacacgtgtgttcggttccctctaccaagcacagaaccgtcgcttcagcaacacctcagtcaaggtgatggatgttgatgctggtgacagagagacagtccatcccttggttgtgactcatcctggctctggaaggaaaggcctttatgtgaatcaagtctactgtcagagaattgagggcatgacagatgcagaatcaaagccattgcttcagttcctctatgagcatgccaccagatttgacttcacttgccgtgtgaggtggaagaaagaccaagtccttgtctgggacaacttgtgcaccatgcaccgtgctgttcctgactatgctggcaagttcagatacttgactcgcaccacagttggtggagttaggcctgcccgctaataagtagttagcttaatcacctagggtcgcagcgtgtgcgtgtccgtcgtacgttctggccggccgggccttgggcgcgcgatcagaagcgttgcgttggcgtgtgtgtgcttctggtttgctttaattttaccaagtttgtttcaaggtggatcgcgtggtcaaggcccgtgtgctttaaagacccaccggcactggcagtgagtgttgctgcttgtgtaggctttggtacgtatgggctttatttgcttctggatgttgtgtactacttgggtttgttgaattattatgagcagttgcgtattgtaattcagctgggctacctggacattgttatgtattaataaatgctttgctttcttctaaagatctttaagtgcttaggtagttaatattgcggccgcttatattccatttaatcattaccctgttatccctagcggccgcttaggccgcttacacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttg

SEQ ID NO: 191 - DNA, 17194 bp, Artificial Sequence
  RV025340
gtcagcatcatcacaccaaaagttaggcccgaatagtttgaaattagaaagctcgcaattgaggtctacaggccaaattcgctcttagccgtacaatattactcaccagatcctaaccggtgtgatcatgggccgcgattaaaaatctcaattatatttggtctaatttagtttggtattgagtaaaacaaattcggcgccatgcccggccatgcccgggtagggataacagggtaatagatggttcctgtgtgaggcggccgcctcgaggctggctagtcacgactcatggccaaaagtgaagagtcaagacagctttggcattttgtcatgaaatttctctaaccaagactggcaagaatgtgtatgtgtgttctccaatgatttggtgaacagatttaagaaccttgttaccgtatctacctcagctggtgtgatcaagttgctgtcatgcattgcatgccactgcctccaggaaacataaagctttcataagaattatgatcacagataatttatccttgtaaaaaaaacctagctaacatagtaataacctggatcacttatcactcaaataaataatatgaatctgagctatactacgagaacttctggattcagcaagaactagcagcaatcagaacccaatagcatagcaacaaaccgaacaatcaaccatatattaggagacggtagatagaaccacgttaacattaagggggtgtttgaatgcactgaaactaattgttagttggctaaaaattgttagttgaattagctagctaacaaataactacctcactattaactaattttccaaaaatagctaatagttcaactattagctatggtgtttggatgttttaactaattttagccactaactattagttttagtgcattcaaacacctcctaagtaagaaacggtagatagccagtacctgcaggcaaatattaggagacaactgaaagacagaacataatgagcacaggctttaatttcaaacatcaaacttattcatgatttgtcatagttctgggtagtacgcacacacaacacaaccggtccattattaaaccaacactgacacgactcatgacacgaacagcagatactttgacaacctccatatggagagagggcaccagacgacgcaggcacatcggcagcttaaacgacccatgacctaggtgattaagctaactacttagaagttgatctcgccgttattgaatttcctgcggacctcttccagcgtcagggtgccggccttgatcatctccccgccaatgagcagttcctcgacggagagcacagcgccattgcagttggtcttcctgttgaggcgcgtcagctgcgccttgtagttacccttgaaatgcccggagacaaacaggaatttgaactcggtcacggagcttggatacaccttccaccactcattcgggttaatgtgcttgttcctggtttggttttccttgacgtagcgctgcatctcatcggcctggccgattgggagattgtacccgccgctgtaagccttcgtgtcgacgatcacgccataatcgatcggggaacccacggtgtagatcgcgccgtctggcttcctgctaccccccaggtgtttgccgcgatagccgtacaccttcataaagaactccatgaccttcatttcgagaatcctgtcttgggtggagttgcgggcaatctcgatcagctcgatgtactcatgcgggacgtacttgagcttgtgcctgagttcgcttttcttctcttccagctccctggcagcggcctcgctcttgctcttgaccagctgggatccccgcagtccgcagcgttgggcatgctttgtgcggttggcgctctgcgcaaactttctcccacagatgtcgcaggcgaatggcttctcaccggtgtgcgtccggatgtgccggctcaggtcgtcactacgggagaagttcctcatgcagatccggcactgaaacggtttctgtgaacccgtatggatctttgtgtggcgggtcaggttgccggaggtggcgaacttgcggccgcaaatgtcgcacgcaaacggcttttcgccagtgtgggtgcggatatggcgggacaggtgggagcggtcgctgaagttgcgcatacagatgcggcattggaaaggcttttccccggtgtgtatcttggtgtgggtcttgcggtcggcggagcgggcaaactttctcatgcaaatcctacactggaatggcctctccgccatagcagcgggtaccccgtggatgcccaccttcctgtacctggacctcctggcggactccctgttggactccttcctcttcctcggggccatcctagggccgggattctcctccacgtcaccgcatgttagaagacttcctctgccctctccgccgccagatctgaagttgatctcgccgttattgaatttcctgcggacctcttccagcgtcagggtgccggccttgatcatctccccgccaatgagcagttcctcgacggagagcacagcgccattgcagttggtgatgtggttgaggcgcgtcagctgcgccttgtagttacccttgaaatgcccggagacaaacaggaatttgaactcggtcacggagcttggatacaccttccaccactcattcgggttcaggtgcttgtccctggtttggttttcctcgacgtagcgctccatctcatcggcctggccgattgggagattgtacccgccgctgtaagccttcgtgtcgacgatcacgccataatcgatcggggaacccacggtgtagatcgcgccgtctggcttcctgctaccccccaggtgtttgccgcgatagccgtacaccttcataaagaactccatgaccttcatttcgagaatcctgtcttgggtggagttgcgggcaatctcgatcagctcgatgtactcatgcgggacgtacttgagcttgtgcctgagttcgcttttcttctcttccagctccctggcagcggcctcgctcttgctcttgaccagctgggatccccgcagtccgcagcgttgggcatgcttcaggcgggcgccggtgtccgcaaactttctcccacagatgtcgcaggcgaatggcttctcaccggtgtgcgtccggatgtggcgggtcaggtcgccggactgggagaagttcctcatgcagatccggcactgaaacggtttgggaatcggtgcccttgggtgcgtatggatctttgtgtgctcgcgcaggttgtcggagcgggcgaacttgcggccgcaaatgtcgcacgcaaacggcttttcgccagtgtgggtgcggatatggcgggtcagggagccggactgtgagaagttgcgcatacagatgcggcattggaaaggcttttccccggtgtgtatcttggtgtgcttggacaggtcgtcggagcgggcaaactttctcatgcaaatcctacactggaatggcctctccgccatagcagcgggtaccccgtggatgcccaccttcctgtacctggacctcctggcggactccctgttggactccttcctcttcctcggggccatggtgtcgtgtacctgcagaagtaacaccaaacaacagggtgagcatcgacaaaagaaacagtaccaagcaaataaatagcgtatgaaggcagggctaaaaaaatccacatatagctgctgcatatgccatcatccaagtatatcaagatcgaaataattataaaacatacttgtttattataatagataggtactcaaggttagagcatatgaatagatgctgcatatgccatcatgtatatgcatcagtaaaacccacatcaacatgtatacctatcctagatcgatatttccatccatcttaaactcgtaactatgaagatgtatgacacacacatacagttccaaaattaataaatacaccaggtagtttgaaacagtattctactccgatctagaacgaatgaacgaccgcccaaccacaccacatcatcacaaccaagcgaacaaaaagcatctctgtatatgcatcagtaaaacccgcatcaacatgtatacctatcctagatcgatatttccatccatcatcttcaattcgtaactatgaatatgtatggcacacacatacagatccaaaattaataaatccaccaggtagtttgaaacagaattctactccgatctagaacgaccgcccaaccagaccacatcatcacaaccaagacaaaaaaaagcatgaaaagatgacccgacaaacaagtgcacggcatatattgaaataaaggaaaagggcaaaccaaaccctatgcaacgaaacaaaaaaaatcatgaaatcgatcccgtctgcggaacggctagagccatcccaggattccccaaagagaaacactggcaagttagcaatcagaacgtgtctgacgtacaggtcgcatccgtgtacgaacgctagcagcacggatctaacacaaacacggatctaacacaaacatgaacagaagtagaactaccgggccctaaccatgcatggaccggaacgccgatctagagaaggtagagagggggggggggggggaggacgagcggcgtaccttgaagcggaggtgccgacgggtggatttgggggagatctggttgtgtgtgtgtgcgctccgaacaacacgaggttggggaaagagggtgtggagggggtgtctatttattacggcgggcgaggaagggaaagcgaaggagcggtgggaaaggaatcccccgtagctgccggtgccgtgagaggaggaggaggccgcctgccgtgccggctcacgtctgccgctccgccacgcaatttctggatgccgacagcggagcaagtccaacggtggagcggaactctcgagaggggtccagaggcagcgacagagatgccgtgccgtctgcttcgcttggcccgacgcgacgctgctggttcgctggttggtgtccgttagactcgtcgacggcgtttaacaggctggcattatctactcgaaacaagaaaaatgtttccttagtttttttaatttcttaaagggtatttgtttaatttttagtcactttattttattctattttatatctaaactattaaataaaaaaactaaaatagagttttagttttcttaatttagaggctaaaatagaataaaatagatgtactaaaaaaattagtctataaaaaccattaaccctaaaccctaaatggatgtactaataaaatggatgaagtattatataggtgaagctatttgcaaaaaaaaaggagaacacatgcacactaaaaagataaaactgtagagtcctgttgtcaaaatactcaattgtcctttagaccatgtctaactgttcatttatatgattctctaaaacactgatattattgtagtactatagattatattattcgtagagtaaagtttaaatatatgtataaagatagataaactgcacttcaaacaagtgtgacaaaaaaaatatgtggtaattttttataacttagacatgcaatgctcattatctctagagaggggcacgaccgggtcacgctgcactcacctttgtcatgcggccgctccggataaattcatccgactcaggttattgtttggcggccgcaagctgtactgaagcttgccgagtgccatccttggacactcgataaagtatattttattttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgatttcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgatattgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacactacaccacaggtacctcttcctggagcaccagtgtccatggacgagagagcgagcgcgatggggaggagggcgtgttgcgcgaaggaaggcgttaagagaggggcgtggacgagcaaggaggacgatgccttggccgcctacgtcaaggcccatggcgaaggcaaatggagggaagtgccccagaaagccggtttgcgtcggtgcggcaagagctgccggctgcggtggctgaactacctccggcccaacatcaggcgcggcaacatctcctacgacgaggaggatctcatcatccgcctccacaggctcctcggcaacaggtggtcgctgattgcaggcaggctgcctggccgaacagacaatgaaatcaagaactactggaacagcacgctgggccggagggcaggcgccggcgccggcgccggcggcagctgggtcgtcgtcgcgccggacaccggctcgcacgccaccccggccgcgacgtcgggcgcctgcgagacgggccagaatagcgccgctcatcgcgcggaccccgactcagccgggacgacgacgacctcggcggcggcggtgtgggcgcccaaggccgtgcggtgcacgggcggactcttcttcttccaccgggacacgacgccggcgcacgcgggcgagacggcgacgccaatggccggtggaggtggaggaggaggaggagaagcagggtcgtcggacgactgcagctcggcggcgtcggtatcgcttcgcgtcggaagccacgacgagccgtgcttctccggcgacggtgacggcgactggatggacgacgtgagggccctggcgtcgtttctcgagtccgacgaggactggctccgctgtcagacggccgggcagcttgcgtaataatgagtagttagcttaatcacctagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgtagttccctcattcactagctgcggccgctgcgaagtagtcaagggtcgcggccgcgtgaagtcgattccttctgaagcttgccgagtgccatccttggacactcgataaagtatattttattttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgatttcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgatattgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacactacaccacaggtacctcttcctggagcaccagtgtccatgcgatgcccgatgcgatcaacggaagcggatggcccgtaaggatagcctgatttactctctattcagtccgtaggtttaatgagtctgttggattagcctacactttttctgtaaaatctattttagatagtagctaaatcagtaaatttggctagtatttttagctattctcttggagtttgctataagaccagaacatgtaaattggaagtttgtggacccggacgagaatgcatgacaaatccagagtattgatgatggaattcacctattttacccgactcttccattgtgtccatttctcatcatccccgggcgctttctgcatccggtacagctgacatgacacgttcacgcgttacatggctgatggctcacaagtcacccccacatgtctagtgttcgcccaggcagatcgtcctcggcctgcgctgccgtgctcttgccgccgcttgcttgggccctgctggcgcccgctgccgatcacacggcctacgcggtgcaggcagcgccaccgaacccgcagtcttgttgtgccgataggtggcagtggcagtggcactggcacggcacgcgatcgatcgctccgctcatctgctgacagtggatagagcagcgttggccgttggggccggatctccgtgaagcggtcgtccctgctgtactgtgccgctatggcgtgtcgctttcgccatgttttcttttcttttttttttctttttctttttgctagggcggtttctcgttcgctggtaacagggaccacttcggttgatccgttgaatttactgaaagagatgggaatggtcgctgtgcccgggacattgaatgagatgttgtgtaagtgaatatggctttagccttttgcgagtggggcggcaatgcacggcatgaactataatttccggtcaaacttttgtgtggaaatggatgctaaacgaacacaaaccgggtttaaaccagaggccgacacggcacacacggcgacattcaccgccggcttcctccgtcgccactcggcacaaggctcatcagtcgctagtctatattgagcggccgctatatgaatgcaatcgaacaatggttaaagcggccgcaaacaaaggcttacttgagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcaggtacacgacaccatggctcatgctgccctcagccctctctcccaacgctttgagagaatagctgtccagccactcactggtgtccttggtgctgagatcactggagtggacttgagggaaccacttgatgacagcacctggaatgagatattggatgccttccacacttaccaagtcatctactttcctggccaagcaatcaccaatgagcagcacattgcattctcaagaaggtttggaccagttgatccagtgcctcttctcaagagcattgaaggctatccagaggttcagatgatccgcagagaagccaatgagtctggaagggtgattggtgatgactggcacacagactccactttccttgatgcacctccagctgctgttgtgatgagggccatagatgttcctgagcatggcggagacactgggttcctttcaatgtacacagcttgggagacgttgtctccaaccatgcaagccaccatcgaagggctcaacgttgtgcactctgccacacgtgtgttcggttccctctaccaagcacagaaccgtcgcttcagcaacacctcagtcaaggtgatggatgttgatgctggtgacagagagacagtccatcccttggttgtgactcatcctggctctggaaggaaaggcctttatgtgaatcaagtctactgtcagagaattgagggcatgacagatgcagaatcaaagccattgcttcagttcctctatgagcatgccaccagatttgacttcacttgccgtgtgaggtggaagaaagaccaagtccttgtctgggacaacttgtgcaccatgcaccgtgctgttcctgactatgctggcaagttcagatacttgactcgcaccacagttggtggagttaggcctgcccgctaataagtagttagcttaatcacctagggtcgcagcgtgtgcgtgtccgtcgtacgttctggccggccgggccttgggcgcgcgatcagaagcgttgcgttggcgtgtgtgtgcttctggtttgctttaattttaccaagtttgtttcaaggtggatcgcgtggtcaaggcccgtgtgctttaaagacccaccggcactggcagtgagtgttgctgcttgtgtaggctttggtacgtatgggctttatttgcttctggatgttgtgtactacttgggtttgttgaattattatgagcagttgcgtattgtaattcagctgggctacctggacattgttatgtattaataaatgctttgctttcttctaaagatctttaagtgcttagtagaagagggcacttaagcggccgcaattaggagcgtgtgcagactggaacgcccatgcggccgcctaactgacttctttagaattggcacaggaacactggccactgcccttgatgtgcaattatgcctgcgaaagcctaggcaacacacgcgaataaacgagcgaatgacacggaaagctgatgtggtatgaattatacaacattatgggccaaaatattattctatccaccattgtgtagccacagcatcggtatttgagttgtgcgaggacaaatccctcgtgaggtcaaaaacagcaaataataaacccatctcctgaagacaccaaaaaaaaggagcagctcctcgtgtcaatgaacaagcgtcacaagaaaagggagcacgtaaataacctcttcaattgcttcagcatgaaaagaacgggaagaaatgcaagtctacagaggaaagtgcagctgtttcggctgccatggcaagttcctacatgggcgaggaaaagctgaactggattccagtcttcgcgctgtcatgctcagcttgctttaggatgcggcaatagttcacctggatgaaaaagatacaagttagtcttgaagcagtcgagtggacatccaaagtatcaaaatcgaaagcttgtaaatggggaaggaaatatacctctacccggaaaagtttggtaggcaaaataatcccaacgccagcagagctccggaacgtttgccgaaattcagaagccgaaaagttcttgtactcaccctccgacagtttcgcaaggtttccagcagtaaggaatgcgtggccatggattccagcgtctctgaatatcttgaggggcagatcaaaagaaaggtcagcgaaggcagacacggccagatcacctcccaagtaatcccttccagggtcagccgagccactctccgagttattaaggacatgcctccgcgcctctgttgggccaactccccttaatctgaaacccagcagagatgacggtccgcccaagctgcacactggagaagaattacctccaagataaaacctctctggcactgatgaagtcgaattcatgcgatgcccgatgcgatcaacggaagcggatggcccgccgacgagacacctcaaggacccatttaaatcgttattagtaaggcgcgtgatggcgctctcagcttccccggctcaggaagaactgctgcagcctgctgggaggccgttgaggaagcagcttgctgcagccgcgaggagcatcaactggagctatgccctcttctggtccatttcaagcactcaacgacctcgggtgctgacgtggacggacgggttctacaatggcgaggtgaagacgcgtaagatctcccactccgtggagctgacagccgaccagctgctcatgcagaggagcgagcagctccgggagctctacgaggccctccggtccggcgagtgcgaccgccgcgcggcgcggccggtgggctcgctgtcgccggaggacctcggggacaccgagtggtactacgtgatctgcatgacctacgccttcctgccgggccaaggcttgcccggcaggagttccgcgagcaacgagcatgtctggctgtgcaacgcgcacctcgccggcagcaaggacttcccccgcgcgctcctggccaagagcgcgtccattcagacaatcgtctgcatcccgctcatgggtggcgtgcttgagcttggtactactgataaggtgccggaggacccggacttggtcagccgagcaaccgtagcattctgggagccgcaatgtccgacatactcgaaagagccgagctccaacccgtcagcatacgaaaccggggaagccgcatacatagtcgtgttggaggacctcgatcacaatgccatggacatggagacggtgactgccgccgccgggagacacggaaccggacaggagctaggagaagtcgagagcccgtcaaatgcaagcctggagcacatcaccaaggggatcgacgagttctacagcctctgcgaggaaatggacgtgcagccgctagaggatgcctggataatggacgggtctaatttcgaagtcccgtcgtcagcgctcccggtggatggctcaagcgcacccgctgatggttctcgcgcgacaagtttcgtggtttggacgaggtcatcgcactcctgctcgggtgaagcggcggcggtgccggtcatcgaggagccgcagaaattgctgaagaaagcgttggccggcggcggtgcttgggcgaacacgaactgcggtggcgggggcacgacggtaacagcccaggaaaacggcgccaagaaccacgtcatgtcagagcgaaagcgccgggagaagctcaacgagatgttcctcgttctcaagtcgttggttccctccattcacaaggtggacaaagcatccatcctcgccgaaacgatagcctatctaaaggagcttcaacgaagggtacaagaactggaatccaggaggcaaggtggcagtgggtgtgtcagcaagaaagtctgtgtgggctccaactccaagaggaagagtccagagttcgccggtggcgcgaaggagcacccctgggtcctccccatggacggcaccagcaacgtcaccgtcaccgtctcggacacgaacgtgctcctggaggtgcaatgccggtgggagaagctcctgatgacacgggtgttcgacgccatcaagagcctccatttggacgctctctcggttcaggcttcggcaccagatggcttcatgaggctcaagataggagctcagtttgcaggctccggcgccgtcgtgcccggaatgatcagccaatctcttcgtaaagctatagggaagcgataataatgagtagttagcttaatcacctagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgtaggtagttaatattgcggccgcttatattccatttaatcattaccctgttatccctagcggccgcttaggccgcttacacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttg

SEQ ID NO: 192 - DNA, 8914 bp, Artificial Sequence
  PHP91539
aacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgagctcggtacggccagaatggcccggaccgggttaccaagcggccgcatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagcaacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgaccgtcgacccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccagggcccggtgaccaatcgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaattt

SEQ ID NO: 193 - DNA, 9976 bp, Artificial Sequence
  RV025340
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgggttaccgaattcgagctcggtaccctgggatccgatatcgatgggccctggccgaagcttggtcacccggtccgggcctagaaggccagcttcaagtttgtacaaaaaagcaggctccggccagaatggcccggaccgggttaccgaattcgagctcggtaccctgggatccggtgcgggcctcttcgctattacgccagctggcgaaagggggatgtgctgcaaggcgattaagttgggtaacgccagggttttcccagtcacgacgttgtaaaacgacggccagtgccaagctcagatcagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccggtcgccaccatggccctgtccaacaagttcatcggcgacgacatgaagatgacctaccacatggacggctgcgtgaacggccactacttcaccgtgaagggcgagggcagcggcaagccctacgagggcacccagacctccaccttcaaggtgaccatggccaacggcggccccctggccttctccttcgacatcctgtccaccgtgttcatgtacggcaaccgctgcttcaccgcctaccccaccagcatgcccgactacttcaagcaggccttccccgacggcatgtcctacgagagaaccttcacctacgaggacggcggcgtggccaccgccagctgggagatcagcctgaagggcaactgcttcgagcacaagtccaccttccacggcgtgaacttccccgccgacggccccgtgatggccaagaagaccaccggctgggacccctccttcgagaagatgaccgtgtgcgacggcatcttgaagggcgacgtgaccgccttcctgatgctgcagggcggcggcaactacagatgccagttccacacctcctacaagaccaagaagcccgtgaccatgccccccaaccacgtggtggagcaccgcatcgccagaaccgacctggacaagggcggcaacagcgtgcagctgaccgagcacgccgtggcccacatcacctccgtggtgcccttctgaagcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgctgatccgatatcgatgggccctggccgaagcttggtcacccggtccgggcctagaaggccgatctcccgggcacccagctttcttgtacaaagtggccgttaacggatcggccagaatggcccggaccgggttaccaagcggccgcatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagcaacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgaccgtcgacccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccagggcccggtgaccaatcgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccggatccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcctcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcggccatggcggcgcgcagctcttcagtgtctggaacgacacttaaggtaccttcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 194 - DNA, 12399 bp, Artificial Sequence
  PHP91539
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactaaccggttcactagctagctgctaagcgactaattaactagctgtcccacggcctaactagcacttaatcccctagcctaacctaagagcgctaatctaggctagtggtcacttagggctttaagtgcagtcgacgggcccggtgatagtttggttaccaagcggccgcatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagcaacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgaccgtcgacccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccagggcccggtgaccaatcgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcaccggtcaccccggggctcggcgttaggcttttagtccgctaggtggctagaccgaggttaggacgctagttcactaggggcctagtggtgttttaaggatatcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatatataggctctattattattattattaattaaactcgctctaaggaggaaagtgggaggaagggacgaggacgaagactactggaagcatcgtccttggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatatatactgtacatgcctccctccaacacccaaccacctcctgctcggctcttaataacttggacacggatcgatgccatccaaggaagaacacgacgacgacgacggaacatccaccatgcaagctagcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcagagatctccctcctcaaggaccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccaagcttggcgcgccggtcacccggtccgggcctagaaggccacccggggcgacttattgaactagtctagggcgcggctaacaacctagcttagattgccttgtctaaacccttaggctaacgcgccaccccacccagcaggcagcagcagtatccaacgaccgaagccgaggccggccacactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcccggcggatctcgactctagaggatcgctcaggaaggccgctgagatagagccatggggaggagggcgtgttgcgcgaaggaaggcgttaagagaggggcgtggacgagcaaggaggacgatgccttggccgcctacgtcaaggcccacggcgaaggcaaatggagggaagtgccccagaaagccggtttgcgtcggtgcggcaagagctgccggctgcggtggctgaactacctccggcccaacatcaggcgcggcaacatctcctacgacgaggaggatctcatcatccgcctccacaggctcctcggcaacaggtggtcgctgattgcaggcaggctgcctggccgaacagacaatgaaatcaagaactactggaacagcacgctgggccggagggcaggcgccggcgccggcgccggcggcagatccacgatggcgctttcagcttcccgagttcagcaggcggaagaactgctgcaacgacctgctgagaggcagctgatgaggagccagcttgctgcagccgccaggagcatcaactggagctacgccctcttctggtccatttcagacactcaaccaggggtgctgacgtggacggacgggttctacaacggcgaggtgaagacgcggaagatttccaactccgtggagctgacatccgaccagctcgtcatgcagaggagcgaccagctccgggagctctacgaggccctcctgtcgggcgagggcgaccgccgcgctgcgcctgcgcggccggccggctctctgtcgccggaggacctcggcgacaccgagtggtactacgtggtgtccatgacctacgccttccggccaggccaagggttgcccggcaggagtttcgcgagcgacgagcatgtctggctgtgcaacgcgcacctcgccggcagcaaagccttcccccgcgcgctcctcgccaagagcgcgtccattcagtcaatcctctgcatcccggttatgggcggcgtgcttgagcttggtacaactgacacggtgccggaggccccggacttggtcagccgagcaaccgcggctttctgggagccgcagtgcccgagctccagcccgtcaggacgagcaaacgagacgggcgaggccgcagcagacgacggcacgtttgcgttcgaggaactcgaccacaataatggcatggacgacatagaggcgatgaccgccgccgggggacacgggcaggaggaggagctaagactaagagaagccgaggccctgtcagacgacgcaagcctggagcacatcaccaaggagatcgaggagttctacagcctctgcgacgaaatggacctgcaggcgctaccactaccgctagaggacggctggaccgtggacgcgtccaatttcgaggtcccctgctcttccccgcagccagcgccgcctccggtggatagggctaccgctaacgtcgccgccgacgcctcaagggcacccgtctacggctctcgcgcgacgagtttcatggcttggacgaggtcctcgcagcagtcgtcgtgctccgacgacgcggcgcccgcagcagtagtgccggccatcgaggagccgcagagattgctgaagaaagtggtggccggcggcggtgcttgggagagctgtggcggcgcgacgggagcagcacaggaaatgagtggcactggcaccaagaaccacgtcatgtcggagcgaaagcgacgagagaagctcaacgagatgttcctcgtcctcaagtcactgcttccgtccattcacagggtgaacaaagcgtcgatcctcgccgaaacgatagcctacctcaaggagcttcagagaagggtgcaagagctggagtccagtagggaacctgcgtcgcgcccatccgaaacgacgacaaggctaataacaaggccctcccgtggcaataatgagagtgtgaggaaggaggtctgcgcgggctccaagaggaagagcccagagctcggcagagacgacgtggagcgccccccggtcctcacgatggacgccggcaccagcaacgtcaccgtcaccgtctcggacaaggatgtgctcctggaggtgcagtgccggtgggaggagctcctgatgacgcgagtgttcgacgccatcaagagcctccatttggacgtcctctcggttcaggcttcagcgccagatggcttcatggggcttaagatacgagctcagtttgctggctccggtgccgtcgtgccctggatgatcagcgaggctcttcgcaaagctatagggaacccctgggtcgtcgtcgcgccggacaccggctcgcacgccaccccggccgcgacgtcgggcgcctgcgagacgggccagaatagcgccgctcatcgcgcggaccccgactcagccgggacgacgacgacctcggcggcggcggtgtgggcgcccaaggccgtgcggtgcacgggcggactcttcttcttccaccgggacacgacgccggcgcacgcgggcgagacggcgacgccaatggccggtggaggtggaggaggaggaggagaagcagggtcgtcggacgactgcagctcggcggcgtcggtatcgcttcgcgtcggaagccacgacgagccgtgcttctccggcgacggtgacggcgactggatggacgacgtgagggccctggcgtcgtttctggagtccgacgaggactggctccgctgtcagacggccgggcagcttgcgtagtggccaggtaccactaactatctatactgtaataatgttgtatagccgccggatagctagctagtttagtcattcagcggcgatgggtaataataaagtgtcatccatccatcaccatgcgtggcaacgtgagcaatgacctgattgaacaaattgaaatgaaaagaagaaatatgttatatgtcaacgagatttcctcataatgccactgacgacgtgtgtccaagaaatgtatcagtgatacgtatattcacaatttttttatgacttatactcacaatttgtttttttactacttatactcacaatttgttgtgcgtaccataacaatttcgatcgaatatatatcagaaagttgacgaaagtaagctcactcaaaaagttaaatgggctgcggaagctgcgtcaggcccaagttttggctattctatccggtatccacgattttgatggctgagggacatatgttcgcttaagcttgcctctaacacgctaaccccttagagagttcctaacgccctagactagttcaataagtcggcctaactaaactgggttaacggcgcgaaacgtgcaagcgctactagacaattcagtacattaaaaacgtccgcaatgtgttattaagttgtctaagcgtcaatttgtttacaccacaatatatcctgcca

SEQ ID NO: 195 - DNA, 1522 bp, Agrobacterium tumefaciens
ctaccggcgcggcagcgttacccgtgtcggcggctccaacggctcgccatcgtccagaaaacacggctcatcgggcatcggcaggcgctgctgcccgcgccgttcccattcctccgtttcggtcaaggctggcaggtctggttccatgcccggaatgccgggctggctgggcggctcctcgccggggccggtcggtagttgctgctcgcccggatacagggtcgggatgcggcgcaggtcgccatgccccaacagcgattcgtcctggtcgtcgtgatcaaccaccacggcggcactgaacaccgacaggcgcaactggtcgcggggctggccccacgccacgcggtcattgaccacgtaggccgacacggtgccggggccgttgagcttcacgacggagatccagcgctcggccaccaagtccttgactgcgtattggaccgtccgcaaagaacgtccgatgagcttggaaagtgtcttctggctgaccaccacggcgttctggtggcccatctgcgccacgaggtgatgcagcagcattgccgccgtgggtttcctcgcaataagcccggcccacgcctcatgcgctttgcgttccgtttgcacccagtgaccgggcttgttcttggcttgaatgccgatttctctggactgcgtggccatgcttatctccatgcggtaggggtgccgcacggttgcggcaccatgcgcaatcagctgcaacttttcggcagcgcgacaacaattatgcgttgcgtaaaagtggcagtcaattacagattttctttaacctacgcaatgagctattgcggggggtgccgcaatgagctgttgcgtaccccccttttttaagttgttgatttttaagtctttcgcatttcgccctatatctagttctttggtgcccaaagaagggcacccctgcggggttcccccacgccttcggcgcggctccccctccggcaaaaagtggcccctccggggcttgttgatcgactgcgcggccttcggccttgcccaaggtggcgctgcccccttggaacccccgcactcgccgccgtgaggctcggggggcaggcgggcgggcttcgcccttcgactgcccccactcgcataggcttgggtcgttccaggcgcgtcaaggccaagccgctgcgcggtcgctgcgcgagccttgacccgccttccacttggtgtccaaccggcaagcgaagcgcgcaggccgcaggccggaggcttttccccagagaaaattaaaaaaattgatggggcaaggccgcaggccgcgcagttggagccggtgggtatgtggtcgaaggctgggtagccggtgggcaatccctgtggtcaagctcgtgggcaggcgcagcctgtccatcagcttgtccagcagggttgtccacgggccgagcgaagcgagccagccggtggccgctcgcggccatcgtccacatatccacgggctggcaagggagcgcagcgaccgcgcagggcgaagcccggagagcaagcccgtaggggg

SEQ ID NO: 196 - DNA, 2400 bp, Agrobacterium tumefaciens
cacctaaacgaaggccgggccactcacccggccttttttgtacgctcatagggcagaacaaaccaacgttttatctataccgctacagggtatttaattcctatttaatctgcgctagaatgaggcatgtttaaccgaatctgacgttttccctgcaaatgccaaaatactatgcctatctccgggtttcgcgtgacggccaagacccggaaaaccaaaaatacggtttgctcgaatacgcgaacgccaaaggcttcgcgccgctacagatcgaggaagaaattgccagcagagcaaaggactggcgcaagcgcaagctcggagcaatcatcgaaaaggccgagcgtggcgacgtgctactgacgccggagattacgcgcattgccggttccgccctcgccgccttggaaattctcaaagcggcgagcgagcgcggcctaatcgtccatgtgaccaaacagaagatcatcatggacggcagcctacaaagcgacatcatggcaaccgtgcttggcttggctgcacagatcgagcggcatttcattcaggcacgtaccaccgaggcgctacaagtcgccagagagcgcggcaagacgctcgggcgacccaagggcagcaaatcgagcgccttgaagctggacagccgtattgatgaagtacaggcatacgtgaaccttggcttgccgcaaagtcgcgcagccgagttgttaggcgtcagccctcacaccttgcgcctgttcatcaaacgccggaacatcaaacccacaaacactagaccaaccatcaccatgccggggagggaacaacatgcctaagaacaacaaagcccccggccatcgtatcaacgagatcatcaagacgagcctcgcgctcgaaatggaggatgcccgcgaagctggcttagtcggctacatggcccgttgccttgtgcaagcgaccatgccccacaccgaccccaagaccagctactttgagcgcaccaatggcatcgtcaccttgtcgatcatgggcaagccgagcatcggcctgccctacggttctatgccgcgcaccttgcttgcttggatatgcaccgaggccgtgcgaacgaaagaccccgtgttgaaccttggccggtcgcaatcggaatttctacaaaggctcggaatgcacaccgatggccgttacacggccacccttcgcaatcaggcgcaacgcctgttttcatccatgatttcgcttgccggcgagcaaggcaatgacttcggcattgagaacgtcgtcattgccaagcgcgcttttctattctggaatcccaagcggccagaagatcgggcgctatgggatagcaccctcaccctcacaggcgatttcttcgaggaagtcacccgctcaccggttcctatccgaatcgactacctgcatgccttgcggcagtctccgcttgcgatggacatttacacgtggctgacctatcgcgtgttcctgttgcgggccaagggccgccccttcgtgcaaatcccttgggtcgccctgcaagcgcaattcggctcatcctatggcagccgcgcacgcaactcgcccgaactggacgataaggcccgagagcgggcagagcgggcagcactcgccagcttcaaatacaacttcaaaaagcgcctacgcgaagtgttgattgtctatcccgaggcaagcgactgcatcgaagatgacggcgaatgcctgcgcatcaaatccacacgcctgcatgtcacccgcgcacccggcaagggcgctcgcatcggcccccctccgacttgaccaggccaacgctacgcttggcttggtcaagccttcccatccaacagcccgccgtcgagcgggcttttttatccccggaagcctgtggatagagggtagttatccacgtgaaaccgctaatgccccgcaaagccttgattcacggggctttccggcccgctccaaaaactatccacgtgaaatcgctaatcagggtacgtgaaatcgctaatcggagtacgtgaaatcgctaataaggtcacgtgaaatcgctaatcaaaaaggcacgtgagaacgctaatagccctttcagatcaacagcttgcaaacacccctcgctccggcaagtagttacagcaagtagtatgttcaattagcttttcaattatgaatatatatatcaattattggtcgcccttggcttgtggacaatgcgctacgcgcaccggctccgcccgtggacaaccgcaagcggttgcccaccgtcgagcgccagcgcctttgcccacaacccggcggccgcaacagatcgttttataaatttttttttttgaaaaagaaaaagcccgaaaggcggcaacctctcgggcttctggatttccgatcaacgcaggagtcgttcggaaagtagctgttccagaa

SEQ ID NO: 197 - DNA, 3207 bp, Agrobacterium tumefaciens
cacctaaacgaaggccgggccactcacccggccttttttgtacgctcatagggcagaacaaaccaacgttttatctataccgctacagggtatttaattcctatttaatctgcgctagaatgaggcatgtttaaccgaatctgacgttttccctgcaaatgccaaaatactatgcctatctccgggtttcgcgtgacggccaagacccggaaaaccaaaaatacggtttgctcgaatacgcgaacgccaaaggcttcgcgccgctacagatcgaggaagaaattgccagcagagcaaaggactggcgcaagcgcaagctcggagcaatcatcgaaaaggccgagcgtggcgacgtgctactgacgccggagattacgcgcattgccggttccgccctcgccgccttggaaattctcaaagcggcgagcgagcgcggcctaatcgtccatgtgaccaaacagaagatcatcatggacggcagcctacaaagcgacatcatggcaaccgtgcttggcttggctgcacagatcgagcggcatttcattcaggcacgtaccaccgaggcgctacaagtcgccagagagcgcggcaagacgctcgggcgacccaagggcagcaaatcgagcgccttgaagctggacagccgtattgatgaagtacaggcatacgtgaaccttggcttgccgcaaagtcgcgcagccgagttgttaggcgtcagccctcacaccttgcgcctgttcatcaaacgccggaacatcaaacccacaaacactagaccaaccatcaccatgccggggagggaacaacatgcctaagaacaacaaagcccccggccatcgtatcaacgagatcatcaagacgagcctcgcgctcgaaatggaggatgcccgcgaagctggcttagtcggctacatggcccgttgccttgtgcaagcgaccatgccccacaccgaccccaagaccagctactttgagcgcaccaatggcatcgtcaccttgtcgatcatgggcaagccgagcatcggcctgccctacggttctatgccgcgcaccttgcttgcttggatatgcaccgaggccgtgcgaacgaaagaccccgtgttgaaccttggccggtcgcaatcggaatttctacaaaggctcggaatgcacaccgatggccgttacacggccacccttcgcaatcaggcgcaacgcctgttttcatccatgatttcgcttgccggcgagcaaggcaatgacttcggcattgagaacgtcgtcattgccaagcgcgcttttctattctggaatcccaagcggccagaagatcgggcgctatgggatagcaccctcaccctcacaggcgatttcttcgaggaagtcacccgctcaccggttcctatccgaatcgactacctgcatgccttgcggcagtctccgcttgcgatggacatttacacgtggctgacctatcgcgtgttcctgttgcgggccaagggccgccccttcgtgcaaatcccttgggtcgccctgcaagcgcaattcggctcatcctatggcagccgcgcacgcaactcgcccgaactggacgataaggcccgagagcgggcagagcgggcagcactcgccagcttcaaatacaacttcaaaaagcgcctacgcgaagtgttgattgtctatcccgaggcaagcgactgcatcgaagatgacggcgaatgcctgcgcatcaaatccacacgcctgcatgtcacccgcgcacccggcaagggcgctcgcatcggcccccctccgacttgaccaggccaacgctacgcttggcttggtcaagccttcccatccaacagcccgccgtcgagcgggcttttttatccccggaagcctgtggatagagggtagttatccacgtgaaaccgctaatgccccgcaaagccttgattcacggggctttccggcccgctccaaaaactatccacgtgaaatcgctaatcagggtacgtgaaatcgctaatcggagtacgtgaaatcgctaataaggtcacgtgaaatcgctaatcaaaaaggcacgtgagaacgctaatagccctttcagatcaacagcttgcaaacacccctcgctccggcaagtagttacagcaagtagtatgttcaattagcttttcaattatgaatatatatatcaattattggtcgcccttggcttgtggacaatgcgctacgcgcaccggctccgcccgtggacaaccgcaagcggttgcccaccgtcgagcgccagcgcctttgcccacaacccggcggccgcaacagatcgttttataaatttttttttttgaaaaagaaaaagcccgaaaggcggcaacctctcgggcttctggatttccgatcaacgcaggagtcgttcggaaagtagctgttccagaactagattgcgcgtcccccttggtcaaattgggtatacccatttgggcctagtctagccggcatggcgcattacagcaatacgcaatttaaatgcgcctagcgcattttcccgaccttaatgcgcctcgcgctgtagcctcacgcccacatatgtgctaatgtggttacgtgtattttatggaggttatccaatgagccgcctgacaatcgacatgacggaccagcagcaccagagcctgaaagccctggccgccttgcagggcaagaccattaagcaatacgccctcgaacgtctgttccccggtgacgctgatgccgatcaggcatggcaggaactgaaaaccatgctggggaaccgcatcaacgatgggcttgccggcaaggtgtccaccaagagcgtcggcgaaattcttgatgaagaactcagcggggatcgcgcttgacggcctacatcctcacggctgaggccgaagccgatctacgcggcatcatccgctacacgcgccgggagtggggcgcggcgcaggtgcgccgctatatcgctaagctggaacagggcatagccaggcttgccgccggcgaaggcccgtttaaggacatgagcgaactctttcccgcgctgcggatggcccgctgcgaacaccactacgttttttgcctgccgcgtgcgggcgaacccgcgttggtcgtggcgatcctgcatgagcgcatggacctcatgacgcgacttgccgacaggctcaagggctgatttcagccgctaaaaatcgcgccactcacaacgtcctgatggcgtactaagctggg

SEQ ID NO: 198 - DNA, 3085 bp, Agrobacterium tumefaciens
accgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctat

SEQ ID NO: 199 - DNA, 3604 bp, Agrobacterium tumefaciens
atggcgaagtctgtcctaaaagcagcgcctgtagttgtagggttgacggccttgatggagcgtcatgccgatgccctctcgagccaacttcaagcacatcatcttaaggttttcccgccgcattccgagaagggcattcgaacattcgggccatcggaggcgtccaagctgctcggcgttggcgagtcatatttacggcagaccgcgtctgagatgccagagttgaatgttagcatgagcccgggtggcaggcgaatgttctcaattgaagatatccatgcgattcggaagtatatggatcaggtcggccgcgggaaccggcgctacctgccacatcgtcgaggcggcgagcagcttcaggttatctctgtgatgaatttcaaaggtgggtcgggtaagaccaccaccgccgcgcatctggcgcagtacctcgctatgcgcggatatcgagtcttggccattgatctcgatcctcaagcgagcctttctgcactctttgggagccaaccggagacggacgttggcccgaacgaaacgctctacggcgctataaggtatgatgatgagcaggtggcaatcgaacgagtcgtccgagggacttacattcccgacctccacctgattcctggtaatcttgagctgatggagtttgaacacgatacgccacgcgcgctgatgaaccgcaaagagggcgacacgctcttttatggtcgcatcagccaagtaattgaagatatcgcggataactatgacgtcgtggtcatcgactgccctccccagcttgggtatctcacgctatccgcattgactgcggcgacgtccattcttgtcacggtccatccgcagatgctggatgtgatgtcgatgaaccagtttctggcaatgacatcgaaccttttgcgtgaaatcgagaatgctggcgccaagttcaagtttaattggatgcgctatctgataacccgtttcgaaccgagcgacggaccacagaaccaaatggtaggttatctgcggtcgatttttggcgaaaatgtcctcaattttccgatgcttaaaaccaccgcggtttcggacgctggcctgacaaaccagactctattcgaagtggagcgtggcctgttcacgcgctcgacctatgatcgagccttggaggcgatgaacgccgtcaacgacgagatcgaaacactgatcaaaaaagcatggggtaggcccacatgagccggaagcacatccttggcgtctcaactgacgcccctgagacgtcgcccgccgacaataggacggcaaagaaccgctccatgccgctcctcggcgtaacaaggaaggagcgcgatccggcaacgaagctcacagcgaacattggtaacgcactgcgagagcaaaacgatcgtcttagccgtgccgaagagatcgagcggcgtctcgctgaaggtcaggcagtgatagagttggatgcctcgtcaatagaaccgtctttcgtgcaggatcgtatgcgaggggacattgacgggctccttacttcgatccgggaacaaggacagcaagtcccaatccttgtgcgaccgcatccgagccagccgggccgatatcaggttgccttcggccaccgccggctacgcgccgtttcagaactcggacttccggtcagagcggtcgttcgcgaactgacggacgagcaagtggtcgtagcacagggtcaggaaaacaatgagcgcgaagatcttaccttcatcgaaaaggcgcgcttcgcacatcgcctgaacaggcagttttctcgagagattgtcatcgccgcgatgtcgatcgacaagagcaatttgtccaagatgcttctgctcgttgacgccctcccctctgaactgaccgatgctattggtgccgctcctggtgttggacggccgagttggcaacaacttgccgagctgattgagaaagtttcttcaccggccgacgtggctaaatatgctatgtcggaggaagttcaagcgctgccatcggcagaacgattcaaggcggtgatcgctagtctgaagcccagtcgggttgcgcgtggacttcccgaggtcatggccaccccagacggcaccagaattgcacaggtgacgcagagcaaggccaaactggaaatcacgattgacaggaaggcgacgcccgattttgcgaccttcgtgctcgatcatgtgccagcgctgtatcaagcgtaccacgctgagaaccaacggaaacggggagagtaaaccgcaaaagaaaagagccccctcaacgtcgccgtcgcggaagcccttctgtctctctagcgcgaacagaatcgcatttcctcgaatcctcgtcaagagtttttagcgccgttttggtgagctgatttcctttgcctgctgaaaggtgaaagatgatgcagacaggaagtgtaacgacgccattcgggcggcggccaatgacgcttgcgcttgtgcggcgccagacggcgctggccgatatcaaacaaggcaagacagcggacaagtggaaggtctttagagacgcgtccgcggctatggaactacttggaatccagtccaacagtcttgccgtccttgatgcgctattgagctttcacccggaaacggagttgcgtcaggaggcacagctgatcgtcttcccgtcgaatgctcagcttgcccttcgggcgcatgggatggctggcgcgactttgcgtaggcacatcgccatgctcgtggagtcaggcttgatcgtccggaaggatagcgccaacggaaagcgttacgctcgtaaggatggcgctggtcagatcgagcgcgcgtttggcttcgatttgtctccgcttctcgcgcggtcggaagagctagcgatgatggcacagcaggtgatggccgatcgagcagcattcaggatggccaaagaaagtctgacgatttgccgacgggacgttcggaagctaattacggcagctatggaagagggagcggagggcgactggcaagctgtcgaggaagtctatgtggaacttgtgggtagaattccacgcgccccgacgcttgctgatgtagagtcaattctcgaagagatgtggatgctccaggaagagataatcaaccggttggaaattagagacaattcagaaaataatagcaccaatgctgcccagagcgagcagcacatacagaattcaaaacccgaatccgttaatgaacttgaacctcgctctgaaaaggagcagggcgctaagccgagtgaaatagaccgggcaaggagcgagccgataaaagcgttccccctcgggatgatcctgaaagcatgcccgaccattggcaactatgggccgagcggtgcggttgctagctggcgtgacctcatgtcggctgcggtggtggttcggtctatgctgggggtcagcccgtcggcttaccaagacgcgtgtgaggcaatgggaccggagaatgcggcagcagcgatggcgtgcattttggagcgagcgaacttcatcaattcgcccgggggctatctccgagatctgacacggcggagcgagcttgggaagttttcacttggcccgatgataatggcgctcttgaaggctagcgggcaggggacgttgcggtttggctag

SEQ ID NO: 200 - DNA, 14902 bp, Agrobacterium tumefaciens
ctttccgacgctcaccgggctggttgccctcgccgctgggctggcggccgtctatggccctgcaaacgcgccagaaacgccgtcgaagccgtgtgcgagacaccgcggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggcagtccttgccattgccgggatcggggcagtaacgggatgggcgatcagcccgagcgcgacgcccggaagcattgacgtgccgcaggtgctggcatcgacattcagcgaccaggtgccgggcagtgagggcggcggcctgggtggcggcctgcccttcacttcggccgtcggggcattcacggacttcatggcggggccggcaatttttaccttgggcattcttggcatagtggtcgcgggtgccgtgctcgtgttcaattcagcgggttcgtgcgatccgtctgcatgatggtgatagccgtcagcatgattttcgtgtcgtcgaacttggtgaagggcattctcggcggcgatcacgacgccggccctgcggagccttcgccgcgtgcgcgattcatggcggccgtggaggccaaggatttcgcgcgagtgcaagagctgatcgaggcgcgtggagccaagtcggcggctgattatgtccttgcgcagctcgccgtggccgaaggtctggaccgcaagcctggtgcgcgcgtcgtggtcgggaaagcggcgggcagcatggcaatgccgcctgcggcgctgggttttacgccaaggggagaagcggcatacgccatcgagcggtcagcctatggtgagccgaggtccagcattgcgaagcagtaccagcaggaatggaaccggaaggcggcgacctggtgggcgatggccggtgtggccggcatcatcggcgcgatcctggcggcggcggcaaccggctttgttgggctggcagtgtcgatccgcaaccgagtgaagcgcgtgcgcgacctgttggtgatggagccgggtgcagagccataagcggcaagagacgaaagcccggtttccgggcttttgttttgttacgccaaggacgagttttagcggctaaaggtgttgacgtgcgagaaatgtttagctaaacttctctcatgtgctggcggctgtcaccgctatgttcaaccaaggcgcggagcaaattatgggtgttatccatgaagaaacggcttaccgaaagccagttccaggaggcgatccaggggctggaagtggggcagcagaccatcgagatagcgcggggcgtcttagtcgatgggaagccacaggcgacgttcgcaacgtcgctgggactgaccaggggcgcagtgtcgcaagcggtgcatcgcgtgtgggccgcgttcgaggacaagaacttgcccgaggggtacgcgcgggtaacggcggttctgccggaacatcaggcgtacatcgtccggaagtgggaagcggacgccaagaaaaaacaggaaaccaaacgatgaaaactttggtcacggccaaccagaaaggcggcgtcggcaagacttcgacccttgtgcatcttgccttcgactttttcgagcgcggcttgcgggttgccgtgatcgacctggacccccagggcaatgcgtcctacacgctcaaggactttgctaccggcctgcatgcaagcaagctgttcggcgctgtccctgccggcggctggaccgaaaccgcacccgcagccggcgacggccaggccgcgcgcctcgccctcatcgagtccaacccggtactggcgaacgccgaacggctgtcgctggacgacgcccgcgagctgttcggggcgaacatcaaggccctggcgaaccaaggcttcgacgtgtgcctgatcgacacggccccgacccttggcgtcggcctggcggccgccctcttcgcggccgactatgtgctgtcccccatcgagcttgaggcgtacagcatccagggcatcaagaagatggtcacgaccattgcgaacgtgcgccagaagaacgccaagctgcaattccttggcatggtgcccagcaaggtcgatgcgcggaatccgcgccacgcgcgccaccaagccgagctgctggccgcgtaccccaagatgatgattccggccaccgttggcctgcgcagcagcatcgccgatgccctcgcatccggtgtgccggtctggaagatcaagaaaacggccgcgcgcaaggcatcgaaagaggttcgcgccctggctgattacgtgttcacgaagatggagatttcccaatgactgcggctcaagccaagaccaccaagaaaaacaccgctgcggccgctcaggaagccgcaggcgcggcgcagccgtccggcctggggttggatagcatcggcgacctgtcgagcctcctggacgctcctgcggcgtctcagggcggttccggccctatcgagctggacctggacctgatcgacgaagatccgcatcagccgcggacggccgacaaccccggcttttccccggagagcatcgcggaaatcggtgccacgatcaaagagcgcggggtgaagtcacccatttcggtgcgcgagaaccaggagcagccgggccgctatatcatcaatcacggcgcccgccgctaccgtggctcgaagtgggccggcaagaagtccatcccggcgttcatcgacaacgactacaacgaagccgaccaggttatcgagaacctgcaacgcaacgagctgaccccgcgcgaaattgccgacttcattggccgcgagctggcgaagggcaagaagaaaggcgatatcgccaaggaaatcggcaagtcgccggcgttcatcacccagcacgtcacgctgctggacctgccggagaagatcgccgatgcgttcaacaccggccgcgtgcgcgacgtgaccgtggtgaacgagctggtgacggccttcaagaagcgcccggaggaagtcgaggcgtggcttgacgacgacacccaggaaatcacgcgcggcacggtcaagctgctgcgcgagttcctggacgagaagggccgcgatcccaacaccgtcgatgccttcaacggccagactgatgccgagcgtgacgcggaggccggcgacggccaggacggcgaggacggcgaccaggacggtaaggacgccaaggaaaagggcgcgaaggagccggacccggacaagctgaaaaaggccatcgtccaggtcgagcacgacgagcgccctgcccgccttatcctcaaccgtcggccgccggcggaaggctatgcctggttgaagtacgaggacgacggccaggagttcgaggcgaaccttgccgacgtgaaactggtcgcgctcatcgagggctgatccccaaagacagcggcgcgggccacccgcgccgcacagacaacggttccgctacaaggaggaccgaagaatgaatccgatgctgttctacatcgcgggaggcgtaggcgcggcgttgctgctggtttccgcgatcatgctgttcaagctgcgcgagccgaagaaggaacaccgaccgcagcgcaaggcggcggccccgacgccgcagccggtcgataacgagctgctgcgcacctttcgccggccgtcgcaggccagccaacccgagccatccacgacgccgccggcgcggcgcactgccccgccgagcagcgaacaatccagagggaatgacggcgatttcgtcacgtcggccctggtggccggggcgaccaacagcaccatgctgggctacctggccggcggctcgctgaccggggccatgctgggcgatgcgctgcggccggatacgccgtctgcggcgttcgcggacccctcgccgtgcttcggcagcagcgacacggacagcggctggaccgataccggcagctcttgcgatttcagttcgtccgacaccgatacgaacaactggtgagggcggaccatgactgacgaacaaaagaaacggctcctgatgttgcaagctatccggcgcagcatccaggcaatgcgcaggggtgtttcggggccggatagtttcaagggctggttgaccggcatcggcatcatcgcggcggggttcctggttggcgagctgctgccatcccctgcccccggcgtcggcctggttgtgccaggggcctgcattgccggcttcgtcgtcggctgctggctcaacaggaaaggccgctcatggccgacagccatttacgaccaattggcccgttaccagccgctcaacgagcgggcgtaccgcgacctgcaagagacggtgaaggaacgcggcctcgactgcgatgcggtcatggagtggacctacatcgagcaggccgagttcatgcccctggtgcccaccagggaggacctagcgcgcgacaagttcctgaccgcgacgcgggccgatagggccgaggacgatgcgcgtgcgcgcttcgtcgtgctccatcccaagaagcgcggccccgacgcatgaagaagcccgacgcccgctaatccccttcccgctgaccctttgcccccgccgaccgtgcggggctttttttgcctgcccttcagccgctaaaaaacctgccgttaagtcgagaactgttcagctaaactcttgcgctgataaggtaggtaagagtattattattcttaccaattaccggagccaacatggaactgaacaaagagacgcgcgaccgcatttttgcggctgcggacgagctgttcgagcaaggcgaccgggagaacttcccgaccgtggatgcagtgcgtaaggccgcccgcgtcaacatgaacgacgccagcgccggcatgcgcgaatggcgacgccagcgcacggcgcaggccgccccgctggcagtccaggtgccggacgcggtgcagcaggccggcaaccaggccgtggccgccctctggcaagccgcccaggcccttgccaatgaatcgttgcaggcagcgcaagccggctgggatcgtgagcgcaacgagttggaagccgtgcgcggggagctggccgacgccttcgaggcgcaggcccgcgagctggaagaagcccaggcgcgcgttacattgctagagcagcaggccgccgaggcggccgagctggccgcacgccagcggcaagccctggccgaagcacgcaccgccctggcaggagccgagcagcgggccgcgctggcgacgcagcgggccgacgaggtggagcgtcgagcgcaggagctgcgcgccgagctggactacgctcaccaggacgcccgcgcattcaaagaagagagccgcaagaccctggacgcggccaaccaggaaatgcaggcgcttcgcggcgagcgcgacgccaccaggcgcgaagcggagagtttgcgcacggagttggcagcggtgaaagcgaaggcgcaggccgacgccgaggcccaccaggagcaaaggaagttggcggcgcaagaggcggccaggcaggccgagcgctttacgacggtgcaagccgagcgtgacgaagcgcggcaagaggcaaaggcagcccaagaagaggccgctatgttgaggggtcggctagacgcggaaacgagtgggaggaaacacaaagcgggaggaaagtaactgataaatcgaacgcagttcactaaaatagatggaacaaccttgacgcgcccggctctagggaaagccggcctcgaactgccgaggtcggcttttttttagccggcaagcgaccaggacacgtttaacaccagaggcaaccgtcaggagtcacccaatgaaacaccgcctcctggtcatgaatgggcaaagaattgtccagaccgagaaccaaggcgcatggacgaaccagaaggtagataaagccggggccctgaaacctggcatttacaacatctatatggcccaaaaggccgataagtcgcagcgccacgacggcagcatcgtccacgcagatagcggcagcatttaccaacaggtggggaagaactttgtaatgcacgcccggtcagatttcgataaagtacctgaaatcgggagtgcgaaaagcatcacctatgacgcaagtggcaaggcacaggtaagtgccgaaagcgtcaagttgagtcgcgggcgcactcgttagagttttagcggctaaaaagggaggcgtcttgagcagctacagcagagccgagcgcgcaccgtggggagacttcccgaaggtggttcgcaacggcgaccttggttctttgaccaacgagcctgaataccaggctgcgaagcagggcgacgcggaagcggcgcttaatttggtcgagcgcctgatttcggacgacactgttgcccagctcaagacgctgatcggcgacgacaagccccgcatcgttccagtcctcgccgtcgaggcggcggggaacaacaagattccggccatgatggcggtcgttctggccgaccgccttggccttgaggtcgaaacggacattgtgcagcgggagaaggtcgcccgaaccggagccggttcagatcatcgcctggcgttcaacccgactttcgagggggaggtgatccccggccagaagtacatcgttgtcgatgacacgctgacgatgggcggcaccattgcctcattacgcggctacatcgagaacaacggcggcaaggtcatggcggcgtccgtcatgaccgcccatgaaggcgcgcttgacctggcggtcaagccgaagatgcttgcgggcatcaatgagaaacacggtccagcaatggacgcattttggaaggaaacctttggctatggcatcgaccgactcacccaaggagaagccggacacctccgcgctgccccgtccgttgacgcaatccgagatcgcatcgctgcggctcgaaatgaagcagtcaatcgagtgggggcaagccgaactgcgacgacggcgcgagcagggcaacagcagtccccggcagtaaagcagtccagcggcaacagcggcgaggatttgctacaggcggcccaggaggccgagacggaacagcaggccctcttagaatccgcgcccatcgagcagacctaccagcagacccttgcgctctacgtgcaggcaaagcatgaccaggtggagcgcatcgaggaccgcctagaacagctcgtagaccgtcagcaggcgcgtttgcagcagctacagtccaatgcccccggcttgctgtccctgccgcgtacaaaggccgcctggcagcagcagcaggcccaacagcaagcccgcttgcagaccctgcacacgcggctggacatggtgcgcgaaatcaaggaaggcatgggcattcacgcgcccaagatcgaggaactggcgacgcgcaagatgcgcgcggagcatcccgagctggccggcgactgggattcgatgcgtgaagcagcccgacggcaccaggccctgatgcgcaagcaggagcaggagaagaaacaggcccaggagcgcgagcgcgggcgcagtcagagcttgggcctgtcaaacaagcccagctaacgcaaaaacaaagcccggcaacgccgggctttttcatctgcgcctctgcgattcataacgaggcccacaccaccagggcggccgcgaacaacaccatgccgccggcgatcatgttcatcatcgccacgcgccgcgcgtccgcgaccttggccgcgagctggcggccaaggccgtcgtcgatttccctgcggatcgcttcggccgcctgcgcggcgctgtccttcattaccttcgccattgcgtccttgctggccgccagggccgcgttcagcatccgctccgctttggccttggcgtcctcgccccaacgatgggcgatcccttccagctcttccttgaacgcggcaaggatttcctcttgcttggccgcactgtcggccatgagccgggcgttgatggtatgcaggatcagcaccgggtcgtcgcggccgacggcgatgccgtgcttggccgcaatctcccggatcagctcttcaatctggtcgctcatagcacggccgccgcgtcgagctgttcaaacaggccgcgccgcacgatcttgaggcgttgccgcgtcatgatcgtgagcgattcatcggccagcgcctggtcgaacgtcagccgctcttgcagcatgtcgctgaaatcgcggccgtaggtttcttccttgagggccggaatctggatgatggacgacacgcgggccttgttggccgtgtacgccttcatctgctcaaagctcttgccctcatgctcgataggcccccaatacgggttcagccagaccacgaaaagcgcttcggccgggaactggctggcgagctgggcgaagccgctcaccgtgtccaggagagcctggccgccggtgacgacggtatggatgaccagctcatgccccatttcttgcagcagagccggcacctggttgctgatgaggtaatgcgacagaggcacgaacgagctggcaccgttgtcgatcaccacgtcatccttggtcggcgcaatcagctcgaccagggtgtcgaagttgcgcgagttaatttcgtcgccggccatgatgttcagccggcggacgttcagggccttgtagccctcgaacgtcgcgttcaccgggtcggtgtcgatgcacaagggtgtctgccccttgtccatcttgtactgcgcaatgatcgcggcgatggccgacttgccgaccccgcccttgccctgcaaaaccatgtgaattttcgccattacagtagatcctttttgtccggtgttgggttgaaggtgaagccggtcggggccgcagcgggggccggcttttcagccttgcccccctgcttcggccgccgtggctccggcgtcttgggtgccggcgcgggttccgcagccttggcctgcggtgcgggcacatcggcgggcttggccttgatgtgccgcctggcgtgcgagcggaacgtctcgtaggagaacttgaccttccccgtttcccgcatgtgctcccaaatggtgacgagcgcatagccggacgctaacgccgcctcgacatccgccctcaccgccaggaacgcaaccgcagcctcatcacgccggcgcttcttggccgcgcgggattcaacccactcggccagctcgtcggtgtagctctttggcatcgtctctcgcctgtcccctcagttcagtaatttcctgcatttgcctgtttccagtcggtagatattccacaaaacagcagggaagcagcgcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtgaagtacatcaccgacgagcaaggcaagaccgagcgctcttcttcaatcgctgccgtcagacggtcagggaacgccgacaggccccgctccgcgtagttcggagcaggacgccgcacggcgtccacatggatcatccacccacttcccaggcccgcgagggcctggttgatgcgggcggacactacttcgcgctgctggtcggtgctgcttgcgttgtcatcgcccttgtacagccaggcagccataaagctgccgttcttgcccacgattacgccgtcatcgacgacagcggcgtagttgagcagatcggccaggccggcgtccttggaacgatgctttttcagtttcagttcggcatcgaccgcgcggatgcgggcaaagaggatgaacaacagaagcgcgccgaggcccgcgattgcaatcgcaattgcttggatcatcggtattgcttcccttggctattggtgttctcgcggaacggggtcgagcgggccgggtaatacggcttgtaccggcggtgacgcaggtacacgaaccgcatcttcggatcggccttcgccatgattcggaacgcatagagcgccccgaaccacaggatcagaccgaccacggtggcccgcagctcttgggcgctgaaaatcagcgcaaacgccatcaggcccgagaacatcaccagttcacgatcaccacccatgaacaggttttctcggttgcctgcgcgacggatggggatcgtgcgcagagccatgattaggcgagccgtccagccgctaccgcacgcacggcatccgccgccgcgacttgcacctggtgcagcgccccgttgccgagggccgcgatttcggcaccacgaccgaagaaggtgctcatcacgttctgcgcgccgaccagcagcgccatcaccagaaccaggaagatcagggttcggaagaaggcgttgagttcgccgccgaagatcagcacgccgccggcgacgacgatgccgatgatggacagcgcgaaggccaccgggccggttacggagttgcgcaggttcgtcagccagctctcatatggcaagctgccgccggtgccttccgaggccatcgccggatgcgcggataacgcgagagcgagaacgaagaacacggcaaggtagaacaaaatgccgcgattcatggtcagacggaacggaacagccgttgtcattggaaatactccttacagggttttggtgatgtactggccgttctcgtaaccaagaacttcgagaatttcttgcactcgacggccgctaggggtcctggcgatatggacgaccacatgaaccgcctcgccaatcagcggctcaatgggtttcggtgaatccgggtgcatgctgataagcatggcgagccggctcaggcccgctttggggttgtttgcgtgcagggtggcggcacctccttcatgcccggtgttccaggccatcaacagatcaagggcttcggggccacgtacctcaccgaccaggatgcggtcggggcgcatacgcagcgttgtcttgagcagcagcgtcatcgagacgtcgatgctggtgtggtattggacggcgttctctgcggcgcactggatttcgccggtgtcctcgatgatgacgacgcgctcagacgggttgaaggcgaccatttcattgatgatcgcgttgacgagcgtggtcttgcccgagccagtaccgccaatgacgaggatgtttcgatgcgccgcgacggcgcttttaatgacctcgtattgctcgcgggtcatgatgcccgcctcgacgtactgttccagcgtgaagatggcgaccgcgcgcttgcggatcgcaaaggttggcgcggccacgaccggcggcaattggccggcaaagcggctgccatccaaggggaactcgccttccaggatgggcgaatgccgcgtgacctctttgccgtggaatccggccaccgtttctataatcgcctgcgactggctgggccgcatgtcgcagatgtaccgcatcggctcgccaaggcgttcgtgccacaccttgccgtccgcgttgagcatgacttcaacggttttcgggtcgttgagcgcggccaacaggtccgcacccatgtcgcgttccagcttgcgcttggcccgctccttgatggtctgaaactcttctttcccgctcacttttcagtaacccctacgcaacaaatcattagcaacattatcgcacaggcaaacgatataccgaaagtgtttagcctgcaagacaaacagctaatcgaaccgcacgacgtaggggttctgatagaaaacaactgtcaaagcgcacccgcccgatgccattcgcggcacggcttccgttgaggatgtcgatatgatgcgcgagccgacggcccgcagagaaggggccgttttagcggctaaagaaggaagtgcaagccctaacccttggcgtcagagccttccacgcagcttttttcgggtgtcgtcgccccatttctttacgataaacgccttatgtgacggcaaaaccacactgatgcgttcgtatccgggcggcacgctgctcttgaaaggatgacccgcaatctccgcgagtgcctcgcggtcaaggtcggtggactccaggagaagaggtaggggagtttccagggcgtcggcaatggcctccatcaccttcaacgaggggttggccttaccgttggttaagtctgataaaaacgaaattgaaacccctgccctctccgacagctcatgtttcgtcatgccccgctcatcgagcagacgaaggatgttggtgaaaaatatctggttgtacacagcggaagccgcccctcgcacctttggtcgcggcccgcaaaattttagccgctaaagttcttgacagcggaaccaatgtttagctaaactagagtctcctttctcaaggagactttcgatatgagccataatcagttccagtttatcggtaatcttacccgtgacaccgaggtacgtcatggcaattctaacaagccgcaagcaattttcgatatagcggttaatgaagagtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctag

SEQ ID NO: 201 - DNA, 15197 bp, Agrobacterium tumefaciens
atgggtgttatccatgaagaaacggcttaccgaaagccagttccaggaggcgatccaggggctggaagtggggcagcagaccatcgagatagcgcggggcgtcttagtcgatgggaagccacaggcgacgttcgcaacgtcgctgggactgaccaggggcgcagtgtcgcaagcggtgcatcgcgtgtgggccgcgttcgaggacaagaacttgcccgaggggtacgcgcgggtaacggcggttctgccggaacatcaggcgtacatcgtccggaagtgggaagcggacgccaagaaaaaacaggaaaccaaacgatgaaaactttggtcacggccaaccagaaaggcggcgtcggcaagacttcgacccttgtgcatcttgccttcgactttttcgagcgcggcttgcgggttgccgtgatcgacctggacccccagggcaatgcgtcctacacgctcaaggactttgctaccggcctgcatgcaagcaagctgttcggcgctgtccctgccggcggctggaccgaaaccgcacccgcagccggcgacggccaggccgcgcgcctcgccctcatcgagtccaacccggtactggcgaacgccgaacggctgtcgctggacgacgcccgcgagctgttcggggcgaacatcaaggccctggcgaaccaaggcttcgacgtgtgcctgatcgacacggccccgacccttggcgtcggcctggcggccgccctcttcgcggccgactatgtgctgtcccccatcgagcttgaggcgtacagcatccagggcatcaagaagatggtcacgaccattgcgaacgtgcgccagaagaacgccaagctgcaattccttggcatggtgcccagcaaggtcgatgcgcggaatccgcgccacgcgcgccaccaagccgagctgctggccgcgtaccccaagatgatgattccggccaccgttggcctgcgcagcagcatcgccgatgccctcgcatccggtgtgccggtctggaagatcaagaaaacggccgcgcgcaaggcatcgaaagaggttcgcgccctggctgattacgtgttcacgaagatggagatttcccaatgactgcggctcaagccaagaccaccaagaaaaacaccgctgcggccgctcaggaagccgcaggcgcggcgcagccgtccggcctggggttggatagcatcggcgacctgtcgagcctcctggacgctcctgcggcgtctcagggcggttccggccctatcgagctggacctggacctgatcgacgaagatccgcatcagccgcggacggccgacaaccccggcttttccccggagagcatcgcggaaatcggtgccacgatcaaagagcgcggggtgaagtcacccatttcggtgcgcgagaaccaggagcagccgggccgctatatcatcaatcacggcgcccgccgctaccgtggctcgaagtgggccggcaagaagtccatcccggcgttcatcgacaacgactacaacgaagccgaccaggttatcgagaacctgcaacgcaacgagctgaccccgcgcgaaattgccgacttcattggccgcgagctggcgaagggcaagaagaaaggcgatatcgccaaggaaatcggcaagtcgccggcgttcatcacccagcacgtcacgctgctggacctgccggagaagatcgccgatgcgttcaacaccggccgcgtgcgcgacgtgaccgtggtgaacgagctggtgacggccttcaagaagcgcccggaggaagtcgaggcgtggcttgacgacgacacccaggaaatcacgcgcggcacggtcaagctgctgcgcgagttcctggacgagaagggccgcgatcccaacaccgtcgatgccttcaacggccagactgatgccgagcgtgacgcggaggccggcgacggccaggacggcgaggacggcgaccaggacggtaaggacgccaaggaaaagggcgcgaaggagccggacccggacaagctgaaaaaggccatcgtccaggtcgagcacgacgagcgccctgcccgccttatcctcaaccgtcggccgccggcggaaggctatgcctggttgaagtacgaggacgacggccaggagttcgaggcgaaccttgccgacgtgaaactggtcgcgctcatcgagggctgatccccaaagacagcggcgcgggccacccgcgccgcacagacaacggttccgctacaaggaggaccgaagaatgaatccgatgctgttctacatcgcgggaggcgtaggcgcggcgttgctgctggtttccgcgatcatgctgttcaagctgcgcgagccgaagaaggaacaccgaccgcagcgcaaggcggcggccccgacgccgcagccggtcgataacgagctgctgcgcacctttcgccggccgtcgcaggccagccaacccgagccatccacgacgccgccggcgcggcgcactgccccgccgagcagcgaacaatccagagggaatgacggcgatttcgtcacgtcggccctggtggccggggcgaccaacagcaccatgctgggctacctggccggcggctcgctgaccggggccatgctgggcgatgcgctgcggccggatacgccgtctgcggcgttcgcggacccctcgccgtgcttcggcagcagcgacacggacagcggctggaccgataccggcagctcttgcgatttcagttcgtccgacaccgatacgaacaactggtgagggcggaccatgactgacgaacaaaagaaacggctcctgatgttgcaagctatccggcgcagcatccaggcaatgcgcaggggtgtttcggggccggatagtttcaagggctggttgaccggcatcggcatcatcgcggcggggttcctggttggcgagctgctgccatcccctgcccccggcgtcggcctggttgtgccaggggcctgcattgccggcttcgtcgtcggctgctggctcaacaggaaaggccgctcatggccgacagccatttacgaccaattggcccgttaccagccgctcaacgagcgggcgtaccgcgacctgcaagagacggtgaaggaacgcggcctcgactgcgatgcggtcatggagtggacctacatcgagcaggccgagttcatgcccctggtgcccaccagggaggacctagcgcgcgacaagttcctgaccgcgacgcgggccgatagggccgaggacgatgcgcgtgcgcgcttcgtcgtgctccatcccaagaagcgcggccccgacgcatgaagaagcccgacgcccgctaatccccttcccgctgaccctttgcccccgccgaccgtgcggggctttttttgcctgcccttcagccgctaaaaaacctgccgttaagtcgagaactgttcagctaaactcttgcgctgataaggtaggtaagagtattattattcttaccaattaccggagccaacatggaactgaacaaagagacgcgcgaccgcatttttgcggctgcggacgagctgttcgagcaaggcgaccgggagaacttcccgaccgtggatgcagtgcgtaaggccgcccgcgtcaacatgaacgacgccagcgccggcatgcgcgaatggcgacgccagcgcacggcgcaggccgccccgctggcagtccaggtgccggacgcggtgcagcaggccggcaaccaggccgtggccgccctctggcaagccgcccaggcccttgccaatgaatcgttgcaggcagcgcaagccggctgggatcgtgagcgcaacgagttggaagccgtgcgcggggagctggccgacgccttcgaggcgcaggcccgcgagctggaagaagcccaggcgcgcgttacattgctagagcagcaggccgccgaggcggccgagctggccgcacgccagcggcaagccctggccgaagcacgcaccgccctggcaggagccgagcagcgggccgcgctggcgacgcagcgggccgacgaggtggagcgtcgagcgcaggagctgcgcgccgagctggactacgctcaccaggacgcccgcgcattcaaagaagagagccgcaagaccctggacgcggccaaccaggaaatgcaggcgcttcgcggcgagcgcgacgccaccaggcgcgaagcggagagtttgcgcacggagttggcagcggtgaaagcgaaggcgcaggccgacgccgaggcccaccaggagcaaaggaagttggcggcgcaagaggcggccaggcaggccgagcgctttacgacggtgcaagccgagcgtgacgaagcgcggcaagaggcaaaggcagcccaagaagaggccgctatgttgaggggtcggctagacgcggaaacgagtgggaggaaacacaaagcgggaggaaagtaactgataaatcgaacgcagttcactaaaatagatggaacaaccttgacgcgcccggctctagggaaagccggcctcgaactgccgaggtcggcttttttttagccggcaagcgaccaggacacgtttaacaccagaggcaaccgtcaggagtcacccaatgaaacaccgcctcctggtcatgaatgggcaaagaattgtccagaccgagaaccaaggcgcatggacgaaccagaaggtagataaagccggggccctgaaacctggcatttacaacatctatatggcccaaaaggccgataagtcgcagcgccacgacggcagcatcgtccacgcagatagcggcagcatttaccaacaggtggggaagaactttgtaatgcacgcccggtcagatttcgataaagtacctgaaatcgggagtgcgaaaagcatcacctatgacgcaagtggcaaggcacaggtaagtgccgaaagcgtcaagttgagtcgcgggcgcactcgttagagttttagcggctaaaaagggaggcgtcttgagcagctacagcagagccgagcgcgcaccgtggggagacttcccgaaggtggttcgcaacggcgaccttggttctttgaccaacgagcctgaataccaggctgcgaagcagggcgacgcggaagcggcgcttaatttggtcgagcgcctgatttcggacgacactgttgcccagctcaagacgctgatcggcgacgacaagccccgcatcgttccagtcctcgccgtcgaggcggcggggaacaacaagattccggccatgatggcggtcgttctggccgaccgccttggccttgaggtcgaaacggacattgtgcagcgggagaaggtcgcccgaaccggagccggttcagatcatcgcctggcgttcaacccgactttcgagggggaggtgatccccggccagaagtacatcgttgtcgatgacacgctgacgatgggcggcaccattgcctcattacgcggctacatcgagaacaacggcggcaaggtcatggcggcgtccgtcatgaccgcccatgaaggcgcgcttgacctggcggtcaagccgaagatgcttgcgggcatcaatgagaaacacggtccagcaatggacgcattttggaaggaaacctttggctatggcatcgaccgactcacccaaggagaagccggacacctccgcgctgccccgtccgttgacgcaatccgagatcgcatcgctgcggctcgaaatgaagcagtcaatcgagtgggggcaagccgaactgcgacgacggcgcgagcagggcaacagcagtccccggcagtaaagcagtccagcggcaacagcggcgaggatttgctacaggcggcccaggaggccgagacggaacagcaggccctcttagaatccgcgcccatcgagcagacctaccagcagacccttgcgctctacgtgcaggcaaagcatgaccaggtggagcgcatcgaggaccgcctagaacagctcgtagaccgtcagcaggcgcgtttgcagcagctacagtccaatgcccccggcttgctgtccctgccgcgtacaaaggccgcctggcagcagcagcaggcccaacagcaagcccgcttgcagaccctgcacacgcggctggacatggtgcgcgaaatcaaggaaggcatgggcattcacgcgcccaagatcgaggaactggcgacgcgcaagatgcgcgcggagcatcccgagctggccggcgactgggattcgatgcgtgaagcagcccgacggcaccaggccctgatgcgcaagcaggagcaggagaagaaacaggcccaggagcgcgagcgcgggcgcagtcagagcttgggcctgtcaaacaagcccagctaacgcaaaaacaaagcccggcaacgccgggctttttcatctgcgcctctgcgattcataacgaggcccacaccaccagggcggccgcgaacaacaccatgccgccggcgatcatgttcatcatcgccacgcgccgcgcgtccgcgaccttggccgcgagctggcggccaaggccgtcgtcgatttccctgcggatcgcttcggccgcctgcgcggcgctgtccttcattaccttcgccattgcgtccttgctggccgccagggccgcgttcagcatccgctccgctttggccttggcgtcctcgccccaacgatgggcgatcccttccagctcttccttgaacgcggcaaggatttcctcttgcttggccgcactgtcggccatgagccgggcgttgatggtatgcaggatcagcaccgggtcgtcgcggccgacggcgatgccgtgcttggccgcaatctcccggatcagctcttcaatctggtcgctcatagcacggccgccgcgtcgagctgttcaaacaggccgcgccgcacgatcttgaggcgttgccgcgtcatgatcgtgagcgattcatcggccagcgcctggtcgaacgtcagccgctcttgcagcatgtcgctgaaatcgcggccgtaggtttcttccttgagggccggaatctggatgatggacgacacgcgggccttgttggccgtgtacgccttcatctgctcaaagctcttgccctcatgctcgataggcccccaatacgggttcagccagaccacgaaaagcgcttcggccgggaactggctggcgagctgggcgaagccgctcaccgtgtccaggagagcctggccgccggtgacgacggtatggatgaccagctcatgccccatttcttgcagcagagccggcacctggttgctgatgaggtaatgcgacagaggcacgaacgagctggcaccgttgtcgatcaccacgtcatccttggtcggcgcaatcagctcgaccagggtgtcgaagttgcgcgagttaatttcgtcgccggccatgatgttcagccggcggacgttcagggccttgtagccctcgaacgtcgcgttcaccgggtcggtgtcgatgcacaagggtgtctgccccttgtccatcttgtactgcgcaatgatcgcggcgatggccgacttgccgaccccgcccttgccctgcaaaaccatgtgaattttcgccattacagtagatcctttttgtccggtgttgggttgaaggtgaagccggtcggggccgcagcgggggccggcttttcagccttgcccccctgcttcggccgccgtggctccggcgtcttgggtgccggcgcgggttccgcagccttggcctgcggtgcgggcacatcggcgggcttggccttgatgtgccgcctggcgtgcgagcggaacgtctcgtaggagaacttgaccttccccgtttcccgcatgtgctcccaaatggtgacgagcgcatagccggacgctaacgccgcctcgacatccgccctcaccgccaggaacgcaaccgcagcctcatcacgccggcgcttcttggccgcgcgggattcaacccactcggccagctcgtcggtgtagctctttggcatcgtctctcgcctgtcccctcagttcagtaatttcctgcatttgcctgtttccagtcggtagatattccacaaaacagcagggaagcagcgcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtgaagtacatcaccgacgagcaaggcaagaccgagcgctcttcttcaatcgctgccgtcagacggtcagggaacgccgacaggccccgctccgcgtagttcggagcaggacgccgcacggcgtccacatggatcatccacccacttcccaggcccgcgagggcctggttgatgcgggcggacactacttcgcgctgctggtcggtgctgcttgcgttgtcatcgcccttgtacagccaggcagccataaagctgccgttcttgcccacgattacgccgtcatcgacgacagcggcgtagttgagcagatcggccaggccggcgtccttggaacgatgctttttcagtttcagttcggcatcgaccgcgcggatgcgggcaaagaggatgaacaacagaagcgcgccgaggcccgcgattgcaatcgcaattgcttggatcatcggtattgcttcccttggctattggtgttctcgcggaacggggtcgagcgggccgggtaatacggcttgtaccggcggtgacgcaggtacacgaaccgcatcttcggatcggccttcgccatgattcggaacgcatagagcgccccgaaccacaggatcagaccgaccacggtggcccgcagctcttgggcgctgaaaatcagcgcaaacgccatcaggcccgagaacatcaccagttcacgatcaccacccatgaacaggttttctcggttgcctgcgcgacggatggggatcgtgcgcagagccatgattaggcgagccgtccagccgctaccgcacgcacggcatccgccgccgcgacttgcacctggtgcagcgccccgttgccgagggccgcgatttcggcaccacgaccgaagaaggtgctcatcacgttctgcgcgccgaccagcagcgccatcaccagaaccaggaagatcagggttcggaagaaggcgttgagttcgccgccgaagatcagcacgccgccggcgacgacgatgccgatgatggacagcgcgaaggccaccgggccggttacggagttgcgcaggttcgtcagccagctctcatatggcaagctgccgccggtgccttccgaggccatcgccggatgcgcggataacgcgagagcgagaacgaagaacacggcaaggtagaacaaaatgccgcgattcatggtcagacggaacggaacagccgttgtcattggaaatactccttacagggttttggtgatgtactggccgttctcgtaaccaagaacttcgagaatttcttgcactcgacggccgctaggggtcctggcgatatggacgaccacatgaaccgcctcgccaatcagcggctcaatgggtttcggtgaatccgggtgcatgctgataagcatggcgagccggctcaggcccgctttggggttgtttgcgtgcagggtggcggcacctccttcatgcccggtgttccaggccatcaacagatcaagggcttcggggccacgtacctcaccgaccaggatgcggtcggggcgcatacgcagcgttgtcttgagcagcagcgtcatcgagacgtcgatgctggtgtggtattggacggcgttctctgcggcgcactggatttcgccggtgtcctcgatgatgacgacgcgctcagacgggttgaaggcgaccatttcattgatgatcgcgttgacgagcgtggtcttgcccgagccagtaccgccaatgacgaggatgtttcgatgcgccgcgacggcgcttttaatgacctcgtattgctcgcgggtcatgatgcccgcctcgacgtactgttccagcgtgaagatggcgaccgcgcgcttgcggatcgcaaaggttggcgcggccacgaccggcggcaattggccggcaaagcggctgccatccaaggggaactcgccttccaggatgggcgaatgccgcgtgacctctttgccgtggaatccggccaccgtttctataatcgcctgcgactggctgggccgcatgtcgcagatgtaccgcatcggctcgccaaggcgttcgtgccacaccttgccgtccgcgttgagcatgacttcaacggttttcgggtcgttgagcgcggccaacaggtccgcacccatgtcgcgttccagcttgcgcttggcccgctccttgatggtctgaaactcttctttcccgctcacttttcagtaacccctacgcaacaaatcattagcaacattatcgcacaggcaaacgatataccgaaagtgtttagcctgcaagacaaacagctaatcgaaccgcacgacgtaggggttctgatagaaaacaactgtcaaagcgcacccgcccgatgccattcgcggcacggcttccgttgaggatgtcgatatgatgcgcgagccgacggcccgcagagaaggggccgttttagcggctaaagaaggaagtgcaagccctaacccttggcgtcagagccttccacgcagcttttttcgggtgtcgtcgccccatttctttacgataaacgccttatgtgacggcaaaaccacactgatgcgttcgtatccgggcggcacgctgctcttgaaaggatgacccgcaatctccgcgagtgcctcgcggtcaaggtcggtggactccaggagaagaggtaggggagtttccagggcgtcggcaatggcctccatcaccttcaacgaggggttggccttaccgttggttaagtctgataaaaacgaaattgaaacccctgccctctccgacagctcatgtttcgtcatgccccgctcatcgagcagacgaaggatgttggtgaaaaatatctggttgtacacagcggaagccgcccctcgcacctttggtcgcggcccgcaaaattttagccgctaaagttcttgacagcggaaccaatgtttagctaaactagagtctcctttctcaaggagactttcgatatgagccataatcagttccagtttatcggtaatcttacccgtgacaccgaggtacgtcatggcaattctaacaagccgcaagcaattttcgatatagcggttaatgaagagtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccggggaccgccgtgttgctaggatggttgttcttggatcagacgctgagtgcgcttcaaatcatcggcgtcctgctcgtgatcgggagtatctggctgggccaacgttccaaccgcactcctagattgcgcgtcccccttggtcaaattgggtatacccatttgggcctagtctagccggcatggcgcattacagcaatacgcaatttaaatgcgcctagcgcattttcccgaccttaatgcgcctcgcgctgtagcctcacgcccacatatgtgctaatgtggttacgtgtattttatggaggttatccaatgagccgcctgacaatcgacatgacggaccagcagcaccagagcctgaaagccctggccgccttgcagggcaagaccattaagcaatacgccctcgaacgtctgttccccggtgacgctgatgccgatcaggcatggcaggaactgaaaaccatgctggggaaccgcatcaacgatgggcttgccggcaaggtgtccaccaagagcgtcggcgaaattcttgatgaagaactcagcggggatcgcgcttgacggcctacatcctcacggctgaggccgaagccgatctacgcggcatcatccgctacacgcgccgggagtggggcgcggcgcaggtgcgccgctatatcgctaagctggaacagggcatagccaggcttgccgccggcgaaggcccgtttaaggacatgagcgaactctttcccgcgctgcggatggcccgctgcgaacaccactacgttttttgcctgccgcgtgcgggcgaacccgcgttggtcgtggcgatcctgcatgagcgcatggacctcatgacgcgacttgccgacaggctcaagggctgatttcagccgctaaaaatcgcgccactcacaacgtcctgatggcgtactaagctggg

SEQ ID NO: 202 - DNA, 3671 bp, Agrobacterium tumefaciens
tcagcctgccgccttgggccgggtgatgtcgtacttgcccgccgcgaactcggttaccgtccagcccagcgcgaccagctccggcaacgcctcgcgcacccgctggcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccaccatggcatcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatcaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtggtggcgtccctgacgccgatatcgaagcgctcacagcccatggccttgagctgtcggcctatggcctgcaaagtcctgtcgttcttcatcgggccaccaagcgattcccacacattatacgagccggaagcataaagtgtagctagatccgaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttag

SEQ ID NO: 203 - DNA, 1329 bp, Arabidopsis thaliana
atgcatcgcgcgagcagcaaacataccaacgcgaaaaaagaagcgattagcaccagcaaaattcgcgataacaacgtgcgcgtgacccgcagccgcgcgaaagcgctgggcgtgagcaacagcccgagcaaaccggcgtttaaacatgaaaccaaacgcgtggcgcgcccgagcaacaaacgcatggcgagcgataacattaccgtgtgcaaccagaaacgccgcgcggtgctgaaagatgtgaccaacaccctggcggaaagcattattagcaccgaaggcaacgtgaaagcgtgcaaacgcggcggcaaagaaaccaaacagattgaagaagatggcctggtggatgtggatggcgaaaaaagcaaactggcggaagatctgagcaaaattcgcatggtggaaagcctggatgcgagcgcgagcaaacagaaactggtggattgcgcggaagaagatcgcagcgatgtgaccgattgcgtgcagattgtggatattgatagcggcgtgcaggatccgcagttttgcagcctgtatgcggcgagcatttatgatagcattaacgtggcggaactggaacagcgcccgagcaccagctatatggtgcaggtgcagcgcgatattgatccgaccatgcgcggcattctgattgattggctggtggaagtgagcgaagaatataaactggtgagcgataccctgtatctgaccgtgaacctgattgatcgctttatgagccataactatattgaaaaacagaaactgcagctgctgggcattacctgcatgctgattgcgagcaaatatgaagaaattagcgcgccgcgcctggaagaattttgctttattaccgataacacctatacccgcctggaagtgctgagcatggaaattaaagtgctgaacagcctgcattttcgcctgagcgtgccgaccaccaaaacctttctgcgccgctttattcgcgcggcgcaggcgagcgataaagtgccgctgattgaaatggaatatctggcgaactattttgcggaactgaccctgaccgaatatacctttctgcgctttctgccgagcctgattgcggcgagcgcggtgtttctggcgcgctggaccctggatcagagcaaccatccgtggaaccagaccctgcagcattatacccgctatgaaaccagcgcgctgaaaaacaccgtgctggcgatggaagaactgcagctgaacaccagcggcagcaccctgattgcgattcataccaaatataaccagcagaaatttaaacgcgtggcgaccctgaccagcccggaacgcgtgaacaccctgtttagccgc

SEQ ID NO: 204 - protein, 443 aa, Arabidopsis thaliana
MHRASSKHTNAKKEAISTSKIRDNNVRVTRSRAKALGVSNSPSKPAFKHETKRVARPSNKRMASDNITVCNQKRRAVLKDVTNTLAESIISTEGNVKACKRGGKETKQIEEDGLVDVDGEKSKLAEDLSKIRMVESLDASASKQKLVDCAEEDRSDVTDCVQIVDIDSGVQDPQFCSLYAASIYDSINVAELEQRPSTSYMVQVQRDIDPTMRGILIDWLVEVSEEYKLVSDTLYLTVNLIDRFMSHNYIEKQKLQLLGITCMLIASKYEEISAPRLEEFCFITDNTYTRLEVLSMEIKVLNSLHFRLSVPTTKTFLRRFIRAAQASDKVPLIEMEYLANYFAELTLTEYTFLRFLPSLIAASAVFLARWTLDQSNHPWNQTLQHYTRYETSALKNTVLAMEELQLNTSGSTLIAIHTKYNQQKFKRVATLTSPERVNTLFSR

SEQ ID NO: 205 - DNA, 1308 bp, Arabidopsis thaliana
atgtattgcagcagcagcatgcatccgaacgcgaacaaagaaaacattagcaccagcgatgtgcaggaaagctttgtgcgcattacccgcagccgcgcgaaaaaagcgatgggccgcggcgtgagcattccgccgaccaaaccgagctttaaacagcagaaacgccgcgcggtgctgaaagatgtgagcaacaccagcgcggatattatttatagcgaactgcgcaaaggcggcaacattaaagcgaaccgcaaatgcctgaaagaaccgaaaaaagcggcgaaagaaggcgcgaacagcgcgatggatattctggtggatatgcataccgaaaaaagcaaactggcggaagatctgagcaaaattcgcatggcggaagcgcaggatgtgagcctgagcaactttaaagatgaagaaattaccgaacagcaggaagatggcagcggcgtgatggaactgctgcaggtggtggatattgatagcaacgtggaagatccgcagtgctgcagcctgtatgcggcggatatttatgataacattcatgtggcggaactgcagcagcgcccgctggcgaactatatggaactggtgcagcgcgatattgatccggatatgcgcaaaattctgattgattggctggtggaagtgagcgatgattataaactggtgccggataccctgtatctgaccgtgaacctgattgatcgctttctgagcaacagctatattgaacgccagcgcctgcagctgctgggcgtgagctgcatgctgattgcgagcaaatatgaagaactgagcgcgccgggcgtggaagaattttgctttattaccgcgaacacctatacccgcccggaagtgctgagcatggaaattcagattctgaactttgtgcattttcgcctgagcgtgccgaccaccaaaacctttctgcgccgctttattaaagcggcgcaggcgagctataaagtgccgtttattgaactggaatatctggcgaactatctggcggaactgaccctggtggaatatagctttctgcgctttctgccgagcctgattgcggcgagcgcggtgtttctggcgcgctggaccctggatcagaccgatcatccgtggaacccgaccctgcagcattatacccgctatgaagtggcggaactgaaaaacaccgtgctggcgatggaagatctgcagctgaacaccagcggctgcaccctggcggcgacccgcgaaaaatataaccagccgaaatttaaaagcgtggcgaaactgaccagcccgaaacgcgtgaccagcctgtttagccgc

SEQ ID NO: 206 - protein, 436 aa, Arabidopsis thaliana
MYCSSSMHPNANKENISTSDVQESFVRITRSRAKKAMGRGVSIPPTKPSFKQQKRRAVLKDVSNTSADIIYSELRKGGNIKANRKCLKEPKKAAKEGANSAMDILVDMHTEKSKLAEDLSKIRMAEAQDVSLSNFKDEEITEQQEDGSGVMELLQVVDIDSNVEDPQCCSLYAADIYDNIHVAELQQRPLANYMELVQRDIDPDMRKILIDWLVEVSDDYKLVPDTLYLTVNLIDRFLSNSYIERQRLQLLGVSCMLIASKYEELSAPGVEEFCFITANTYTRPEVLSMEIQILNFVHFRLSVPTTKTFLRRFIKAAQASYKVPFIELEYLANYLAELTLVEYSFLRFLPSLIAASAVFLARWTLDQTDHPWNPTLQHYTRYEVAELKNTVLAMEDLQLNTSGCTLAATREKYNQPKFKSVAKLTSPKRVTSLFSR

SEQ ID NO: 207 - DNA, 1116 bp, Arabidopsis thaliana
atgaccgaacaggaaatttgcgtgcgcgtgacccgcgcggcggcgaaacgcaaagcgagcaccgcgatgggcattgatggcgatcgcgtgaacaaaaaacgcgtggtgctgggcgaactgctgaacgtgagcaacgtgaacctgctggcgaacctgaaccagaaaaaagaaacccagaaaccgaaacgcaacctgaaaccgccgccggcgaaacagattaaaagcgcgccggtggcgattattgatctggaaagcaaaagcgatattgatagccgcagcgatgatccgcagatgtgcggcccgtatgtggcggatatttatgaatatctgcgccagctggaagtgaaaccgaaacagcgcccgctgccggattatattgaaaaagtgcagaaagatgtgaccccgagcatgcgcggcgtgctggtggattggctggtggaagtggcggaagaatataaactgggcagcgaaaccctgtatctgaccgtgagccatattgatcgctttctgagcctgaaaaccgtgaacaaacagaaactgcagctggtgggcgtgagcgcgatgctgattgcgagcaaatatgaagaaattagcccgccgaaagtggatgatttttgctatattaccgataacacctttagcaaacaggatgtggtgaaaatggaagcggatattctgctggcgctgcagtttgaactgggccgcccgaccattaacacctttatgcgccgctttacccgcgtggcgcaggatgattttaaagtgccgcatctgcagctggaaccgctgtgctgctatctgagcgaactgagcattctggattataaaaccgtgaaatttgtgccgagcctgctggcggcgagcgcggtgtttctggcgcgctttattattcgcccgaaacagcatccgtggaaccagatgctggaagaatataccaaatataaagcggcggatctgcaggtgtgcgtgggcattattcatgatctgtatctgagccgccgcggcggcgcgctgcaggcggtgcgcgaaaaatataaacatcataaatttcagtgcgtggcgaccatgccggtgagcccggaactgccggtgaccttttgggaagatgtgaccatt

SEQ ID NO: 208 - protein, 372 aa, Arabidopsis thaliana
MTEQEICVRVTRAAAKRKASTAMGIDGDRVNKKRVVLGELLNVSNVNLLANLNQKKETQKPKRNLKPPPAKQIKSAPVAIIDLESKSDIDSRSDDPQMCGPYVADIYEYLRQLEVKPKQRPLPDYIEKVQKDVTPSMRGVLVDWLVEVAEEYKLGSETLYLTVSHIDRFLSLKTVNKQKLQLVGVSAMLIASKYEEISPPKVDDFCYITDNTFSKQDVVKMEADILLALQFELGRPTINTFMRRFTRVAQDDFKVPHLQLEPLCCYLSELSILDYKTVKFVPSLLAASAVFLARFIIRPKQHPWNQMLEEYTKYKAADLQVCVGIIHDLYLSRRGGALQAVREKYKHHKFQCVATMPVSPELPVTFWEDVTI

SEQ ID NO: 209 - DNA, 981 bp, Arabidopsis thaliana
atggtgagcaaaaaagataaacagattcatagcgatcataacccgcaggatgcgagcccggtggaatgggcggaaattcgccataaactgctggcgtttcaggaaaacattcagagcggcagcgatattgatgcgcgcagcgatgatccgcagatgtgcggcctgtatgtgagcgatatttatgaatatctgcgcgaactggaagtgaaaccgaaactgcgcccgctgcatgattatattgaaaaaattcaggaagatattaccccgagcaaacgcggcgtgctggtggattggctggtggaagtggcggaagaatttgaactggtgagcgaaaccctgtatctgaccgtgagctatattgatcgctttctgagcctgaaaatggtgaacgaacattggctgcagctggtgggcgtgagcgcgatgtttattgcgagcaaatatgaagaaaaacgccgcccgaaagtggaagatttttgctatattaccgcgaacacctataccaaacaggatgtgctgaaaatggaagaagatattctgctggcgctggaatttgaactgggccgcccgaccaccaacacctttctgcgccgctttattcgcgtggcgcaggaagattttaaagtgccgaacctgcagctggaaccgctgtgctgctatctgagcgaactgagcatgctggattatagctgcgtgaaatttgtgccgagcctgctggcggcgagcgcggtgtttctggcgcgctttattattctgccgaaccagcatccgtggagccagatgctggaagaatgcaccaaatataaagcggcggatctgcaggtgtgcgtggaaattatgctggatctgtatctgagccgcagcgaaggcgcgagcaaagcggtgcgcgaaaaatataaacagcataaatttcagtatgtggcggcgattccggtgtatcaggaactgccggtgaccttttgggaagatgtggtgaccatt

SEQ ID NO: 210 - protein, 327 aa, Arabidopsis thaliana
MVSKKDKQIHSDHNPQDASPVEWAEIRHKLLAFQENIQSGSDIDARSDDPQMCGLYVSDIYEYLRELEVKPKLRPLHDYIEKIQEDITPSKRGVLVDWLVEVAEEFELVSETLYLTVSYIDRFLSLKMVNEHWLQLVGVSAMFIASKYEEKRRPKVEDFCYITANTYTKQDVLKMEEDILLALEFELGRPTTNTFLRRFIRVAQEDFKVPNLQLEPLCCYLSELSMLDYSCVKFVPSLLAASAVFLARFIILPNQHPWSQMLEECTKYKAADLQVCVEIMLDLYLSRSEGASKAVREKYKQHKFQYVAAIPVYQELPVTFWEDVVTI

SEQ ID NO: 211 - DNA, 1110 bp, Arabidopsis thaliana
atggcggaaaaccagaactgcgcgcgcatgacccgcgcggcggcgaaacgcaaagcgagcagcatggcgctggatgaaaacccggtgagcaaaaaacgcgtggtgctgggcgaactgccgaacatgagcaacgtggtggcggtgccgaaccaggaacgcgaaaccctgaaagcgaaaaccagcgtgaacaccagcaaacgccagatgaaaaaagcgctgatgattccggaagcgagcgtgctgattgaaagccgcagcgtggatccgcagatgtgcgaaccgtttgcgagcgatatttgcgcgtatctgcgcgaaatggaaggcaaaccgaaacatcgcccgctgccggattatattgaaaaagtgcagagcgatctgaccccgcatatgcgcgcggtgctggtggattggctggtggaagtggcggaagaatataaactggtgagcgataccctgtatctgaccattagctatgtggatcgctttctgagcgtgaaaccgattaaccgccagaaactgcagctggtgggcgtgagcgcgatgctgattgcgagccgcaaatatgaagaaattggcccgccgaaagtggaagatttttgctatattaccgataacacctttaccaaacaggaagtggtgagcatggaagcggatattctgctggcgctgcagtttgaactgggcagcccgaccattaaaacctttctgcgccgctttacccgcgtggcgcaggaagattttaaagatagccagctgcagattgaatttctgtgctgctatctgagcgaactgagcatgctggattatacctgcgtgaaatatctgccgagcctgctgagcgcgagcgcggtgtttctggcgcgctttattattcgcccgaaacagcatccgtggaaccagatgctggaagaatataccaaatataaagcggcggatctgcaggtgtgcgtgggcattattcatgatctgtatctgagccgccgcggcaacaccctggaagcggtgcgcaacaaatataaacagcataaatataaatgcgtggcgaccatgccggtgagcccggaactgccgctggcgttttttgaagatattaccattcgcggcatggcg

SEQ ID NO: 212 - protein, 370 aa, Arabidopsis thaliana
MAENQNCARMTRAAAKRKASSMALDENPVSKKRVVLGELPNMSNVVAVPNQERETLKAKTSVNTSKRQMKKALMIPEASVLIESRSVDPQMCEPFASDICAYLREMEGKPKHRPLPDYIEKVQSDLTPHMRAVLVDWLVEVAEEYKLVSDTLYLTISYVDRFLSVKPINRQKLQLVGVSAMLIASRKYEEIGPPKVEDFCYITDNTFTKQEVVSMEADILLALQFELGSPTIKTFLRRFTRVAQEDFKDSQLQIEFLCCYLSELSMLDYTCVKYLPSLLSASAVFLARFIIRPKQHPWNQMLEEYTKYKAADLQVCVGIIHDLYLSRRGNTLEAVRNKYKQHKYKCVATMPVSPELPLAFFEDITIRGMA

SEQ ID NO: 213 - DNA, 1188 bp, Arabidopsis thaliana
atgctgcgcgatggcaacaaacagagcaaaaacaacgtgcgctttgtgcgcaaaagcattaaaaccaccgtgaaaaccagcctgcagaaccgcagcagcctgaaaaaaccgccggtgggccgcagcaaaagccgcagcattagcagcattccgagcagcgcggtggcgagcaccctgagcctgccggaaaaagtggaaaccaaatgcctggaagaagatacccagggcgaaagcagcagcagcggcaacaaagatccgaccaccaaagtgctggatgtgaccgcgaaaccgaaaagcaaacgccgcaaaagctttaccagcctgctggtgaacggcagcaaatttgatgaaaaaaacggcgaaaccaccgaaccggaaaaactgccgagcattgatgatgaaagcaaccagctggaagtggcggaatatgtggatgatatttatcagttttattggaccgcggaagcgctgaacccggcgctgggccattatctgagcgcgcatgcggaagtgagcccggtgacccgcggcattctgattaactggctgattgaagtgcattttaaatttgatctgatgcatgaaaccctgtatctgaccatggatctgctggatcgctatctgagccaggtgccgattcataaaaacgaaatgcagctgattggcctgaccgcgctgctgctggcgagcaaatatgaagattattggcatccgcgcattaaagatctgattagcattagcgcggaaagctatacccgcgaacagattctgggcatggaacgcagcatgctgaaacagctgaaatttcgcctgaacgcgccgaccccgtatgtgtttatgctgcgctttctgaaagcggcgcagagcaacaaaaaactggaacagctggcgttttatctgattgaactgtgcctggtggaatatgaagcgctgaaatataaaccgagcctgctgtgcgcgagcgcgatttatgtggcgcgctgcaccctgcatatgaccccggtgtggaccagcctgctgaacaaccatacccattataacgtgagccagatgaaagattgcagcgatatgattctgcgctttcataaagcggcgaaaaccggcaacctgcgcgtgacctatgaaaaatatattaacccggatcgcagcaacgtggcggtgctgaaaccgctggataaactgccgctg

SEQ ID NO: 214 - protein, 396 aa, Arabidopsis thaliana
MLRDGNKQSKNNVRFVRKSIKTTVKTSLQNRSSLKKPPVGRSKSRSISSIPSSAVASTLSLPEKVETKCLEEDTQGESSSSGNKDPTTKVLDVTAKPKSKRRKSFTSLLVNGSKFDEKNGETTEPEKLPSIDDESNQLEVAEYVDDIYQFYWTAEALNPALGHYLSAHAEVSPVTRGILINWLIEVHFKFDLMHETLYLTMDLLDRYLSQVPIHKNEMQLIGLTALLLASKYEDYWHPRIKDLISISAESYTREQILGMERSMLKQLKFRLNAPTPYVFMLRFLKAAQSNKKLEQLAFYLIELCLVEYEALKYKPSLLCASAIYVARCTLHMTPVWTSLLNNHTHYNVSQMKDCSDMILRFHKAAKTGNLRVTYEKYINPDRSNVAVLKPLDKLPL

SEQ ID NO: 215 - DNA, 1734 bp, Arabidopsis thaliana
atgaaagaaattgcgatgcgcaacagcaaacgcaaaccggaaccgaccccgtttgcgggcaaaaaactgcgcagcacccgcctgcgccgcaaacgcgcgcagattagcccggtgctggtgcagagcccgctgtggagcaaacagattggcgtgagcgcggcgagcgtggatagctgcagcgatctgctggcggatgataacgtgagctgcggcagcagccgcgtggaaaaaagcagcaacccgaaaaaaaccctgattgaagaagtggaagtgagcaaaccgggctataacgtgaaagaaaccattggcgatagcaaatttcgccgcattacccgcagctatagcaaactgcataaagaaaaagaaggcgatgaaattgaagtgagcgaaagcagctgcgtggatagcaacagcggcgcgggcctgcgccgcctgaacgtgaaaggcaacaaaattaacgataacgatgaaattagctttagccgcagcgatgtgacctttgcgggccatgtgagcaacagccgcagcctgaactttgaaagcgaaaacaaagaaagcgatgtggtgagcgtgattagcggcgtggaatattgcagcaaatttggcagcgtgaccggcggcgcggataacgaagaaattgaaattagcaaaccgagcagctttgtggaagcggatagcagcctgggcagcgcgaaagaactgaaaccggaactggaaattgtgggctgcgtgagcgatctggcgtgcagcgaaaaatttagcgaagaagtgagcgatagcctggatgatgaaagcagcgaacagcgcagcgaaatttatagccagtatagcgattttgattatagcgattataccccgagcattttttttgatagcggcagcgaatttagcgaaaaaagcagcagcgatagcccgattagccatagccgcagcctgtatctgcagtttaaagaacagttttgccgcagcaccattccgaacgattttggcagcagctgcgaagaagaaattcatagcgaactgctgcgctttgatgatgaagaagtggaagaaagctatctgcgcctgcgcgaacgcgaacgcagccatgcgtatatgcgcgattgcgcgaaagcgtattgcagccgcatggataacaccggcctgattccgcgcctgcgcagcattatggtgcagtggattgtgaaacagtgcagcgatatgggcctgcagcaggaaaccctgtttctgggcgtgggcctgctggatcgctttctgagcaaaggcagctttaaaagcgaacgcaccctgattctggtgggcattgcgagcctgaccctggcgacccgcattgaagaaaaccagccgtataacagcattcgcaaacgcaactttaccattcagaacctgcgctatagccgccatgaagtggtggcgatggaatggctggtgcaggaagtgctgaactttaaatgctttaccccgaccatttttaactttctgtggttttatctgaaagcggcgcgcgcgaacccggaagtggaacgcaaagcgaaaagcctggcggtgaccagcctgagcgatcagacccagctgtgcttttggccgagcaccgtggcggcggcgctggtggtgctggcgtgcattgaacataacaaaattagcgcgtatcagcgcgtgattaaagtgcatgtgcgcaccaccgataacgaactgccggaatgcgtgaaaagcctggattggctgctgggccag

SEQ ID NO: 216 - protein, 578 aa, Arabidopsis thaliana
MKEIAMRNSKRKPEPTPFAGKKLRSTRLRRKRAQISPVLVQSPLWSKQIGVSAASVDSCSDLLADDNVSCGSSRVEKSSNPKKTLIEEVEVSKPGYNVKETIGDSKFRRITRSYSKLHKEKEGDEIEVSESSCVDSNSGAGLRRLNVKGNKINDNDEISFSRSDVTFAGHVSNSRSLNFESENKESDVVSVISGVEYCSKFGSVTGGADNEEIEISKPSSFVEADSSLGSAKELKPELEIVGCVSDLACSEKFSEEVSDSLDDESSEQRSEIYSQYSDFDYSDYTPSIFFDSGSEFSEKSSSDSPISHSRSLYLQFKEQFCRSTIPNDFGSSCEEEIHSELLRFDDEEVEESYLRLRERERSHAYMRDCAKAYCSRMDNTGLIPRLRSIMVQWIVKQCSDMGLQQETLFLGVGLLDRFLSKGSFKSERTLILVGIASLTLATRIEENQPYNSIRKRNFTIQNLRYSRHEVVAMEWLVQEVLNFKCFTPTIFNFLWFYLKAARANPEVERKAKSLAVTSLSDQTQLCFWPSTVAAALVVLACIEHNKISAYQRVIKVHVRTTDNELPECVKSLDWLLGQ

SEQ ID NO: 217 - DNA, 3177 bp, Arabidopsis thaliana
atgatgaccctgcagatggataaaaccaccgcgagcagcagctgggaacgcgcgaaaagcatttatgatgaaattgcggaactggcgaacaaacgccagaaagcgggcaacccgccggatccgaacctgctgcagctgctgcgcgaaaaatatgaagcgattattctggaaagccatacctttagcgaacagcataacattgaaattccgctgtggcagctgcattataaacgcattgaatattttcgcctgcatattaaccgcgtgctggcgagcagcaccagcaccgcggcgcagaacgtgaaaggcccgagcaaagcggaacagattgcgcagctgaaactgcagtttcgcacctttctgagcgaagcgaccggcttttatcatgatatgattctgaaaattcgcagcaaatatggcctgccgctgggcagctttagcgaagatcagcagagccagaacctgagcgataaagatggcaaagaactggcggaagtgcagaaagcgctgaaaagctgccatcgctgcctgatttatctgggcgatctggcgcgctataaaggcatgtatgcggaaggcgatagccgcagccgccagtatgcgagcgcgagcagctattatctgcaggcggcgagcctgtggccggcgagcggcaacccgcatcatcagctggcgattgtggcgagctatagccgcgatgaatttgtgaccacctatcgctattttcgcagcctggcggtggaatatccgtttccgaccgcgcgcgataacctgattgtggcgtttgataaaaaccgccagagctatgaaaaactgtttgtgccgagcaaagatagcagcaaacgcctgaccggcaaaggccgcggcaaaggcgcggatattagcctgaaagatgcgaccctggtggcgggcccggaaaaagataaagtgaccattgcgaacgaaatgctgaaagcgtttagcattcgctttgtgcatctgaacggcattctgtttacccgcaccagcctggaaaccttttttgatgtgctggcgagcaccagcagcagcctgcgcgaagtgattagcctgggcagcgcgaaagaactgaccctgggcattgataccagcgatagcgcgctgtttattgtgcgcgtggtgaccatgctgatttttagcgtgcataacagcaaaaaagaaaccgaaggccagagctatgcggaaattgtgcagcgcgtggaaccggcgcgcaacagcctgaccgcgagctttgaactgctgggcctggtgattgaaaaatgcgtgcagctgggcgatccgagcagcagctattttctgccgggcgtgctggtgtttgtggaatggctggcgtgctgcccggatattgcgctgggcagcgatccggatgatcgccagaccgcggtgcgcaacagcttttggaaccagtttgtggtgttttttaaccaggtgctgagcctgggcccgacctttattgatgatgtggaagatgaaacctgctttagcaacatgagcctgtatgatgaacgcgaaaccgaaaaccgcctggcgctgtgggaagattatgaactgcgcggctttctgccgctgctgccggcgcagaccattctgaactttagccgcaaacatagctttggcaccgaaggcccgaaagaaaaaaaagcgcgcattaaacgcatttttgcggcgggcaaagcgctgaccagcgtgattaaagtggatcagaaccatgtgtattttgatagcaaaaaaaaaaaatttctggtgggcgtgaaaccggcggatgattttctggatagccatagcagcccgccgaaagcgtgcaacgcgctgcaggataaccaggtgatgattgatcataacagcccgattatgcagctggatcagcagatttatatgggcgaagaagatgatgatgatgaagtgattgtgtttaaaccgctggtgaccgaaaaacgcaaagaagcgagcgatcagatttatgtgccgagcggcggctttcgcaaaagcgatcaggtgaccaccatgggcgattttaaagcgctgagcggcagcgatgtggcgtttcatgaaaaccagattctgcaggcgcgcggcaacgcgagcattcaggtgccggcgagcgtgggcgcgaacctgctgggcccgctgcagccgagcacccagagccaggcgatgcatatgcagcaggtgcagacccaggtgcaggtgccggcgagcgtgggcgcgaacctgctgggcctgctgctgaccagcacccagagccaggcgatgcatatgcagcaggtgcagacccaggcggtgaacccgcagccggcgcagagcctggcggcgagccgcctgcagccgattcagagccaggtggcgcagccgctgccgagccgcgtggtgcattttcagcagacccaggcgcaggtgagccatgtgagcccggcgcatagccagagcaccagctttggcggcggcagcaaatggagcccggaagaagcggcgagcctggcgagcagcctgagcggctttgcgcagctgggcaacggccatgtgatgcgcaacgaaatgcagggcaaccatggcgtgagctattatccggcgcatagcctgccggtgcatcagagctataacggcaacggcatgggcggcatgccgtatagccagagccgcaccccggaagcggtgtttccgccgaaaattgatccggtgctgagcagcggcgtggtggcggatggcctgggcgtgcagagcagcctggcgaaaaaaaacccgattagccgcgcgtttcgccatctgggcccgccgccgggctttaacagcgtgccggcgaaactgcagaaagaaccggcgccgggcagcgaactgagcggcaacaaccatctgccggtggatgattatagctggctggatggctatcaggcgcagagcagccgcggcgtgggcctgaacagcagcctgaactatgcgaccagcggcaaaccggaacatctgggcagcaccggcaacggcctgaacggcccggcgaactttccgtttccgggcaaacaggtgccgaccagccaggtgcaggcggattttccgtattttcagaacccgcagaaagataactttgtggataaaaaccatcagagcacccagctgccggaacagtatcagggccagagcacctggagcagccgccattttgtg

SEQ ID NO: 218 - protein, 1059 aa, Arabidopsis thaliana
MMTLQMDKTTASSSWERAKSIYDEIAELANKRQKAGNPPDPNLLQLLREKYEAIILESHTFSEQHNIEIPLWQLHYKRIEYFRLHINRVLASSTSTAAQNVKGPSKAEQIAQLKLQFRTFLSEATGFYHDMILKIRSKYGLPLGSFSEDQQSQNLSDKDGKELAEVQKALKSCHRCLIYLGDLARYKGMYAEGDSRSRQYASASSYYLQAASLWPASGNPHHQLAIVASYSRDEFVTTYRYFRSLAVEYPFPTARDNLIVAFDKNRQSYEKLFVPSKDSSKRLTGKGRGKGADISLKDATLVAGPEKDKVTIANEMLKAFSIRFVHLNGILFTRTSLETFFDVLASTSSSLREVISLGSAKELTLGIDTSDSALFIVRVVTMLIFSVHNSKKETEGQSYAEIVQRVEPARNSLTASFELLGLVIEKCVQLGDPSSSYFLPGVLVFVEWLACCPDIALGSDPDDRQTAVRNSFWNQFVVFFNQVLSLGPTFIDDVEDETCFSNMSLYDERETENRLALWEDYELRGFLPLLPAQTILNFSRKHSFGTEGPKEKKARIKRIFAAGKALTSVIKVDQNHVYFDSKKKKFLVGVKPADDFLDSHSSPPKACNALQDNQVMIDHNSPIMQLDQQIYMGEEDDDDEVIVFKPLVTEKRKEASDQIYVPSGGFRKSDQVTTMGDFKALSGSDVAFHENQILQARGNASIQVPASVGANLLGPLQPSTQSQAMHMQQVQTQVQVPASVGANLLGLLLTSTQSQAMHMQQVQTQAVNPQPAQSLAASRLQPIQSQVAQPLPSRVVHFQQTQAQVSHVSPAHSQSTSFGGGSKWSPEEAASLASSLSGFAQLGNGHVMRNEMQGNHGVSYYPAHSLPVHQSYNGNGMGGMPYSQSRTPEAVFPPKIDPVLSSGVVADGLGVQSSLAKKNPISRAFRHLGPPPGFNSVPAKLQKEPAPGSELSGNNHLPVDDYSWLDGYQAQSSRGVGLNSSLNYATSGKPEHLGSTGNGLNGPANFPFPGKQVPTSQVQADFPYFQNPQKDNFVDKNHQSTQLPEQYQGQSTWSSRHFV

SEQ ID NO: 219 - DNA, 1326 bp, Arabidopsis thaliana
atgagcagcagcagccgcaacctgagccaggaaaacccgattccgcgcccgaacctggcgaaaacccgcaccagcctgcgcgatgtgggcaaccgccgcgcgccgctgggcgatattaccaaccagaaaaacggcagccgcaacccgagcccgagcagcaccctggtgaactgcagcaacaaaattggccagagcaaaaaagcgccgaaaccggcgctgagccgcaactggaacctgggcattctggatagcggcctgccgccgaaaccgaacgcgaaaagcaacattattgtgccgtatgaagataccgaactgctgcagagcgatgatagcctgctgtgcagcagcccggcgctgagcctggatgcgagcccgacccagagcgatccgagcattagcacccatgatagcctgaccaaccatgtggtggattatatggtggaaagcaccaccgatgatggcaacgatgatgatgatgatgaaattgtgaacattgatagcgatctgatggatccgcagctgtgcgcgagctttgcgtgcgatatttatgaacatctgcgcgtgagcgaagtgaacaaacgcccggcgctggattatatggaacgcacccagagcagcattaacgcgagcatgcgcagcattctgattgattggctggtggaagtggcggaagaatatcgcctgagcccggaaaccctgtatctggcggtgaactatgtggatcgctatctgaccggcaacgcgattaacaaacagaacctgcagctgctgggcgtgacctgcatgatgattgcggcgaaatatgaagaagtgtgcgtgccgcaggtggaagatttttgctatattaccgataacacctatctgcgcaacgaactgctggaaatggaaagcagcgtgctgaactatctgaaatttgaactgaccaccccgaccgcgaaatgctttctgcgccgctttctgcgcgcggcgcagggccgcaaagaagtgccgagcctgctgagcgaatgcctggcgtgctatctgaccgaactgagcctgctggattatgcgatgctgcgctatgcgccgagcctggtggcggcgagcgcggtgtttctggcgcagtataccctgcatccgagccgcaaaccgtggaacgcgaccctggaacattataccagctatcgcgcgaaacatatggaagcgtgcgtgaaaaacctgctgcagctgtgcaacgaaaaactgagcagcgatgtggtggcgattcgcaaaaaatatagccagcataaatataaatttgcggcgaaaaaactgtgcccgaccagcctgccgcaggaactgtttctg

SEQ ID NO: 220 - protein, 442 aa, Arabidopsis thaliana
MSSSSRNLSQENPIPRPNLAKTRTSLRDVGNRRAPLGDITNQKNGSRNPSPSSTLVNCSNKIGQSKKAPKPALSRNWNLGILDSGLPPKPNAKSNIIVPYEDTELLQSDDSLLCSSPALSLDASPTQSDPSISTHDSLTNHVVDYMVESTTDDGNDDDDDEIVNIDSDLMDPQLCASFACDIYEHLRVSEVNKRPALDYMERTQSSINASMRSILIDWLVEVAEEYRLSPETLYLAVNYVDRYLTGNAINKQNLQLLGVTCMMIAAKYEEVCVPQVEDFCYITDNTYLRNELLEMESSVLNYLKFELTTPTAKCFLRRFLRAAQGRKEVPSLLSECLACYLTELSLLDYAMLRYAPSLVAASAVFLAQYTLHPSRKPWNATLEHYTSYRAKHMEACVKNLLQLCNEKLSSDVVAIRKKYSQHKYKFAAKKLCPTSLPQELFL

SEQ ID NO: 221 - DNA, 1302 bp, Arabidopsis thaliana
atgtgcccgtgcgtggaacgccgcgcgccgccgggcgtgtattataccccgccgccggcgcgcaccagcgatcatgtggcggcgatgccgatgaccgaacgccgccgcccgccgtatagctgcagcagcagcagcgaacgccgcgatccgtttcatattgtgcataaagtgccgagcggcgatagcccgtatgtgcgcgcgaaacatgcgcagctgattgataaagatccgaaccgcgcgattagcctgttttggaccgcgattaacgcgggcgatcgcgtggatagcgcgctgaaagatatggcggtggtgatgaaacagctgggccgcagcgatgaaggcattgaagcgattaaaagctttcgctatctgtgcagctttgaaagccaggatagcattgataacctgctgctggaactgtataaaaaaagcggccgcattgaagaagaagcggtgctgctggaacataaactgcagaccctggaacagggcatgggctttggcggccgcgtgagccgcgcgaaacgcgtgcagggcaaacatgtgattatgaccattgaacaggaaaaagcgcgcattctgggcaacctgggctgggtgcatctgcagctgcataactatggcattgcggaacagcattatcgccgcgcgctgggcctggaacgcgataaaaacaaactgtgcaacctggcgatttgcctgatgcgcatgagccgcattccggaagcgaaaagcctgctggatgatgtgcgcgatagcccggcggaaagcgaatgcggcgatgaaccgtttgcgaaaagctatgatcgcgcggtggaaatgctggcggaaattgaaagcaaaaaaccggaagcggatctgagcgaaaaattttatgcgggctgcagctttgtgaaccgcatgaaagaaaacattgcgccgggcaccgcgaacaaaaactatagcgatgtgagcagcagcccggcgagcgtgcgcccgaacagcgcgggcctgtatacccagccgcgccgctgccgcctgtttgaagaagaaacccgcggcgcggcgcgcaaactgctgtttggcaaaccgcagccgtttggcagcgaacagatgaaaattctggaacgcggcgaagaagaaccgatgaaacgcaaaaaactggatcagaacatgattcagtatctgcatgaatttgtgaaagataccgcggatggcccgaaaagcgaaagcaaaaaaagctgggcggatattgcggaagaagaagaagcggaagaagaagaagaagaacgcctgcagggcgaactgaaaaccgcggaaatg

SEQ ID NO: 222 - protein, 434 aa, Arabidopsis thaliana
MCPCVERRAPPGVYYTPPPARTSDHVAAMPMTERRRPPYSCSSSSERRDPFHIVHKVPSGDSPYVRAKHAQLIDKDPNRAISLFWTAINAGDRVDSALKDMAVVMKQLGRSDEGIEAIKSFRYLCSFESQDSIDNLLLELYKKSGRIEEEAVLLEHKLQTLEQGMGFGGRVSRAKRVQGKHVIMTIEQEKARILGNLGWVHLQLHNYGIAEQHYRRALGLERDKNKLCNLAICLMRMSRIPEAKSLLDDVRDSPAESECGDEPFAKSYDRAVEMLAEIESKKPEADLSEKFYAGCSFVNRMKENIAPGTANKNYSDVSSSPASVRPNSAGLYTQPRRCRLFEEETRGAARKLLFGKPQPFGSEQMKILERGEEEPMKRKKLDQNMIQYLHEFVKDTADGPKSESKKSWADIAEEEEAEEEEEERLQGELKTAEM

SEQ ID NO: 223 - DNA, 729 bp, Arabidopsis thaliana
atgccggaagcgcgcgatcgcaccgaacgcccggtggattatagcaccatttttgcgaaccgccgccgccatggcattctgctggatgaaccggatagccgcctgagcctgattgaaagcccggtgaacccggatattggcagcattggcggcaccggcggcctggtgcgcggcaactttaccacctggcgcccgggcaacggccgcggcggccataccccgtttcgcctgccgcagggccgcgaaaacatgccgattgtgaccgcgcgccgcggccgcggcggcggcctgctgccgagctggtatccgcgcaccccgctgcgcgatattacccatattgtgcgcgcgattgaacgccgccgcggcgcgggcaccggcggcgatgatggccgcgtgattgaaattccgacccatcgccaggtgggcgtgctggaaagcccggtgccgctgagcggcgaacataaatgcagcatggtgaccccgggcccgagcgtgggctttaaacgcagctgcccgccgagcaccgcgaaagtgcagaaaatgctgctggatattaccaaagaaattgcggaagaagaagcgggctttattaccccggaaaaaaaactgctgaacagcattgataaagtggaaaaaattgtgatggcggaaattcagaaactgaaaagcaccccgcaggcgaaacgcgaagaacgcgaaaaacgcgtgcgcaccctgatgaccatgcgc

SEQ ID NO: 224 - protein, 243 aa, Arabidopsis thaliana
MPEARDRTERPVDYSTIFANRRRHGILLDEPDSRLSLIESPVNPDIGSIGGTGGLVRGNFTTWRPGNGRGGHTPFRLPQGRENMPIVTARRGRGGGLLPSWYPRTPLRDITHIVRAIERRRGAGTGGDDGRVIEIPTHRQVGVLESPVPLSGEHKCSMVTPGPSVGFKRSCPPSTAKVQKMLLDITKEIAEEEAGFITPEKKLLNSIDKVEKIVMAEIQKLKSTPQAKREEREKRVRTLMTMR

SEQ ID NO: 225 - DNA, 1482 bp, Zea mays
atggctatgcgaaaagaaaaccctgtgcttaatgcttgtcaagcatccaatggccggatcacgcgagctcaagctgctgcaaatcgtcgaagctttggaactttcccttctgttccattgcctgcaaaaaccgaacgaaaacagactgcacaagggaaggcaaaacgaggttcttcatatgacaacaccagtgcaagtgttgcactttcaggcccccagcctaaaaggcgcacagtactcagggatgtgaccaatttgagcaatgctaactctaacaaaagttttgctgctgcaccgaagcttcagacaaagccctctctaaggactggaagaaccgtgagcaaaagcaagccgtgcgcaaaaaagattcctaaaaaaccaccaccagctggtaatggaagtgcattgactaatgttttgaacattgctgaagaaacacaagcggagaagattttggcagagagagtggaacccgttctgttgcttgagaacagggggccactttcattgcagaatgttgaaaggaacagggacagtgcttgtcatgaggtattctttgaggaaagaaacctcagggataaatgtgaaccttctgtgtcaaagaatggggactcttatgtgttagacattgtagatatcgacaaagataatggcaatcctcaaatgtgtgcttcctacgttgtggagatatactcaaacctaatggcttcagagcttatgagaagaccaagtccaaattacatggagggtttgcaacgggacatcacaaagggcatgagagaaatactcattgattggcttgtggaggtttctgaagaatacaagcttgttccagacacgctgtacctaactgtatatcttattgaccggtttctttctcggaactacattgaaagacagagactacaacttgtgggaataacaagcatgcttgttgcctcgaaatatgaagagatatgtgctcctcgagtagaagagttctgtttcataaccgacaatacatacacaaaagcagaggtgctgaaaatggagagccagctgctgaatgacctgggatttaacctttctgttccaactacaaaaacatttctcaggagattccttagagcggcacaagcatctcgtaaaactccttctatgactttaggatttctggccaattatctcgcggagttgactttgaccgaatatgagttcttgaaatttcttccgtcgttggtggcagcatcggccgtgtttcttgctagatggacgcttgaccaatccgacctcccatggaaccagactctagagcactacacctcttacaaatgctctgacattcaattgtgtgtctgtgctctacgggaactccagcataacaccagtaactgccctcttaacgccatccgcgagaagtacaggcatcaaaaggtaatctttatgttggaaaaactcgtacaacattgcttaagcgaagttttcagttacacactttggtag

SEQ ID NO: 226 - protein, 493 aa, Zea mays
MAMRKENPVLNACQASNGRITRAQAAANRRSFGTFPSVPLPAKTERKQTAQGKAKRGSSYDNTSASVALSGPQPKRRTVLRDVTNLSNANSNKSFAAAPKLQTKPSLRTGRTVSKSKPCAKKIPKKPPPAGNGSALTNVLNIAEETQAEKILAERVEPVLLLENRGPLSLQNVERNRDSACHEVFFEERNLRDKCEPSVSKNGDSYVLDIVDIDKDNGNPQMCASYVVEIYSNLMASELMRRPSPNYMEGLQRDITKGMREILIDWLVEVSEEYKLVPDTLYLTVYLIDRFLSRNYIERQRLQLVGITSMLVASKYEEICAPRVEEFCFITDNTYTKAEVLKMESQLLNDLGFNLSVPTTKTFLRRFLRAAQASRKTPSMTLGFLANYLAELTLTEYEFLKFLPSLVAASAVFLARWTLDQSDLPWNQTLEHYTSYKCSDIQLCVCALRELQHNTSNCPLNAIREKYRHQKVIFMLEKLVQHCLSEVFSYTLW

SEQ ID NO: 227 - DNA, 1458 bp, Zea mays
atggctgcaagaaagaaaaagcctttgcttattgcttgccaagcaaccagtgccagaataacaagatctcaggctgctgcaaatagtacaagatctgggctggctccttctgtaccagtacctctgaaaacggagcataaccatgcagcgaaaaaaaagatgaaaagggaagcttcagatgaaaatgcttctgctgatgctggagcttcagctcctctgcctaaaaggcgtacagttctcaagaatgtaactaacataagctgtgctaaaatttccaaaaggtgcactgctgtgactgggctgaagttgggtccctcccagaaggctgggcagagcataaacaagcaatgcacaaacaagatctccatgcttctccctctggctgttggagggagttcacttgtggatgattctaataatgctgaagaaacacaaatggtagaccttttggcacagaaagagaagcagattgttttgcttaaggaggctcagccattacagaatactgaacaaaacaaaggcggtgcttgtgatgaggcatctgttgaggaaagaaatgccatgaatgtacacgaaactgctgccttaaaggctggggtctctaatggtttaaacattgtagatattgacaaaaataatggtgatcctcaaatgtgtgttacctacgttgcagagatatacagaaatctaatggcctcagagcttataagaagacctaggtcaaattacatggagactttgcaacaggacatcacagctagcatgcgaggtgttctaattgattggcttgttgaggtttcggacgaatataagcttgtggcagatacactttaccttacagtatatcttattgaccaatttctttctcagaactgtatccaaacgcacaagctgcaacttcttgggataactagtatgctgattgcctcgaaatatgaagagtattctgctcctagtgctgaagaattttgtaacataacggctggtacatatgcaaaggctgaggttctggaaatggagcaacaagtgcttaatgatctgggctttcatttatctgttccaacaacaaacacatttctcaggagattccttagagcagcacaggcttctcgtacagctcatctgaccactttgaattatctggcgagttatcttgccgagttgactttaatcagttacgatttcatgaaatttcttccctcagaggtggcagcatcttcgattttccttgcaaaatggacacttgaccaatctgaccatccttggaaccctactcttgagcactacacgtcttacaaaagcttcgatattagaacttgcgtgcgggctctacaggaactgcagcacaacaccagtaattgccccctcaacgccatccgtgagaagtatgggcagcagaagttcgagtgcgttgccaacctcaggtcaccggagctgctgcggtcgctcttcagttga

SEQ ID NO: 228 - protein, 485 aa, Zea mays
MAARKKKPLLIACQATSARITRSQAAANSTRSGLAPSVPVPLKTEHNHAAKKKMKREASDENASADAGASAPLPKRRTVLKNVTNISCAKISKRCTAVTGLKLGPSQKAGQSINKQCTNKISMLLPLAVGGSSLVDDSNNAEETQMVDLLAQKEKQIVLLKEAQPLQNTEQNKGGACDEASVEERNAMNVHETAALKAGVSNGLNIVDIDKNNGDPQMCVTYVAEIYRNLMASELIRRPRSNYMETLQQDITASMRGVLIDWLVEVSDEYKLVADTLYLTVYLIDQFLSQNCIQTHKLQLLGITSMLIASKYEEYSAPSAEEFCNITAGTYAKAEVLEMEQQVLNDLGFHLSVPTTNTFLRRFLRAAQASRTAHLTTLNYLASYLAELTLISYDFMKFLPSEVAASSIFLAKWTLDQSDHPWNPTLEHYTSYKSFDIRTCVRALQELQHNTSNCPLNAIREKYGQQKFECVANLRSPELLRSLFS

SEQ ID NO: 229 - DNA, 1584 bp, Zea mays
atgtcgacccacgccgcctcccgccgctcctcctcctcgtccgcggtcgccaagcgccccgcgatagcggagggagctaccaaggcggcgggaccgggccccaccgccgcgcaggcgaagaagcgcaccgcgctcgtcaacatcaccaacgtcgccgctccgggggcgagggtcgccgccgttgggaaggtcgcgccaccggtcaccggcgcgtacctgattagtggaggttccaggcagaggtttgaaataacttgtcccttttgttcaaattcaaatctcatgcagaagttgaatccagctacctcaggtgcacccttaaagaagccatctttggcaaatgctcgcaccatccggggttctgctgcgaagtcggcttccatcaagccagctccaccagtatcacgccatgacagcagctcagagcagaagcataatgttcttgtgcctaccactgtccatgtgccaagtcgtgctcctgccttggtaccctacagcagtttcgtgtctcctggacgttcaagagattcagtttctactgatgagacgatgtcgacttgtgactccatgaaaagcccggacttcgagtacatagacaatgggggttgctcgatgctggcttcgttgcagcgacgggcggatgaacatctgcgtacatcagaggacagagacgttgaagaaaataagtggaagaaaaatggccctgccccaatggaaatcgacagcatctgtgaagttgacagtaacctcgaggatccacagttgtgcgccgctctggcttctgacatctacatgcatctgcgagaagctgagatgaagaaaagaccatcgactgatttcatgaagacgattcaaaaggatgtcaaccctagcatgagggcaattttgatagactggctcgtggaagttgctgaagaatatcgtcttgctcctgataccttgtacctgacagtcaactacatcgaccgttatctttctggcaacgagatcaatcgccaaaggctgcaattacttggtgttgcttgcatgcttatagcggcaaaatacgaggagatatgtgcaccccaggttgaagaattctgctacataacagacaatacatacttcagagacgaggttctagaaatggaagcttctgtgctgaactacttgaagtttgaaatgacagcgcctacggcaaagtgtttcttgaggagatttgctcgttctgcacaggcgtgtgatgaggatcctgctctgcatctggagttcctggccaattacatcgctgagctatccctgctggagtacagtcttctgtcttaccctccatcactaatcgctgcctcagctattttcttggcgagatttgtactccagccaacgaagtatccttggaactccacgcttgctcactacacgcagtacaagccgtccgaattgagcgagtgtgtaaagacactgcaccgcctttccagtgttggtcctgggagcaacctcccagcaatcagagaaaagtacagccagcacaaatacaaatttgtcgcgaagaagcagtgcccgccacaaatccctgccgaattcttcagggatgcggcatgctag

SEQ ID NO: 230 - protein, 527 aa, Zea mays
MSTHAASRRSSSSSAVAKRPAIAEGATKAAGPGPTAAQAKKRTALVNITNVAAPGARVAAVGKVAPPVTGAYLISGGSRQRFEITCPFCSNSNLMQKLNPATSGAPLKKPSLANARTIRGSAAKSASIKPAPPVSRHDSSSEQKHNVLVPTTVHVPSRAPALVPYSSFVSPGRSRDSVSTDETMSTCDSMKSPDFEYIDNGGCSMLASLQRRADEHLRTSEDRDVEENKWKKNGPAPMEIDSICEVDSNLEDPQLCAALASDIYMHLREAEMKKRPSTDFMKTIQKDVNPSMRAILIDWLVEVAEEYRLAPDTLYLTVNYIDRYLSGNEINRQRLQLLGVACMLIAAKYEEICAPQVEEFCYITDNTYFRDEVLEMEASVLNYLKFEMTAPTAKCFLRRFARSAQACDEDPALHLEFLANYIAELSLLEYSLLSYPPSLIAASAIFLARFVLQPTKYPWNSTLAHYTQYKPSELSECVKTLHRLSSVGPGSNLPAIREKYSQHKYKFVAKKQCPPQIPAEFFRDAAC

SEQ ID NO: 231 - DNA, 1119 bp, Zea mays
atggagaactctgccgccgccgccgccgaacggccgcgcctcacccgcgcagccgccaagcgctcagccgtcgtcacggctgtggccgtcgccgccaagcgcaagcgcgtcgcgctcagccagctgcccacgctccccaacgccgtgctcggcgcgcacgacgacgacgacgacaagcccgtcaggaagcagcgcctcctccccgccgccaagcccaagcccaagcccaaggcagcgcccgcgcctgccgcgcccgccgccgcggatgacacggatgacgacattcagctctgcaagccctacgcttccgacatctactcctacctccgctccatggagtcgcaggccaagcgccgcctcgctgttgactacatcgcggcggtgcagatcgacgtcacgcccaacatgcgtggcatcctcatcgactggctcgtcgaggtcgccgaggagtacaagctcgtctccgacacgctctacctcaccgtctcctacatcgaccgcttcctctctgccaaagttctcaacaggcagaagctgcagctcctcggcgtctccgccatgctcatcgcatccaagtatgaggagatcagcccgcccaacgtggaggatttctgctacatcaccgataacacctacaccaagcaggaggtagttaagatggagagtgatatactgaatgtcctcaagtttgaggtgggcagtcctaccgccaagacgttcctgaggatgttcatcagatctgcccaagaagacaacaagaagtatcctagcctccagttggagttcctggggagctacctttctgagctgagcttgctggattatggcttgattcgctccttgccgtcacttgttgcagcctcagccgtctttgttgcaaggctgaccctggatccacacacccatccctggagcaagaaggtgcaaacgctaacaggctataagccatctgagttgaaggactgtgttgctgccatacataatttgcagctcaaccggacatgtcaatccatggtggcgatccgggagaaatacaggcaacaccgattcaagggtgtatcagctttgctacctcctgttgagatccctgcatcatacttcaatacactgaaggagtag

SEQ ID NO: 232 - protein, 372 aa, Zea mays
MENSAAAAAERPRLTRAAAKRSAVVTAVAVAAKRKRVALSQLPTLPNAVLGAHDDDDDKPVRKQRLLPAAKPKPKPKAAPAPAAPAAADDTDDDIQLCKPYASDIYSYLRSMESQAKRRLAVDYIAAVQIDVTPNMRGILIDWLVEVAEEYKLVSDTLYLTVSYIDRFLSAKVLNRQKLQLLGVSAMLIASKYEEISPPNVEDFCYITDNTYTKQEVVKMESDILNVLKFEVGSPTAKTFLRMFIRSAQEDNKKYPSLQLEFLGSYLSELSLLDYGLIRSLPSLVAASAVFVARLTLDPHTHPWSKKVQTLTGYKPSELKDCVAAIHNLQLNRTCQSMVAIREKYRQHRFKGVSALLPPVEIPASYFNTLKE

SEQ ID NO: 233 - DNA, 1272 bp, Zea mays
atgggggacaaggagaacgcacctcccttgggggcccggggcgcggcggcgccccggctcacgcgggccgcggccaagcgagctgcggcggcggcggcggcggcggagggtccgggcgacgccaagcggcggcgggtggcgctcggggagctcccggcgctcgccaacaacgccggcctccgcgcgccgtcctgccccgtcaagccctcgaagcctgcgtccaggcccgggaggcacgcgaggaatgttgcgccggaggcccgcgggccctcctccgcccacgaggccgagcgctgcgcgtcctccccgccgcgcaccgccgacgccgacgccgagtctaactccgtctccaaccccgcgccgcgcgccaccgcctacgccgactcctgcgcttcctcctcgccgccgcgcgccgccgccgccggggcgcccgccgacccccagctctgcgggtcctacgcctccgacatctacacctacctccgctccctggaggtggagccgcagcggcggtccagacccgattacatcgaggcggtgcaggcggacgttacggcgcacatgcgcggcatcctcgtcgactggctggtcgaggtcgccgaggagtataagctcgtcgccgacaccctgtacctcgccatctcctatgtggatcgcttcctctccgtcaatgcgctcggccgcgacaagctgcagctccttggcgtcgcctccatgctcattgctgcgaagtatgaggagatcagcccgccgcacccggaggacttttgctacatcacagacaacacctacaccaaagaggagctcctcaagatggagagcgatatactcaagcttctcaagttcgagttgggcaatcctaccattaagaccttcctgaggcggttcacaagatctgcccatgaagacaagaagcgctccatcttgttaatggaattcttggggagctacctggctgagttgagtctactggattatggctgtctccgattcttgccatcagtagttgctgcttcagttatgttcgttgctaggctgaccattgatccaaatgccaatccttggaacatgaagctgcagaagacgacaggctacaaagtttctgaactcaaggattgcatcgtagccatacgtgacttgcagctcaacaggaaatttccatcattaacggcaattcgagacaagtacaagcaacacaagttcaaatgtgtgtcaacgcttcttccccctgttgtggtccctacttcatactttgaagacttagctgagtag

SEQ ID NO: 234 - protein, 423 aa, Zea mays
MGDKENAPPLGARGAAAPRLTRAAAKRAAAAAAAAEGPGDAKRRRVALGELPALANNAGLRAPSCPVKPSKPASRPGRHARNVAPEARGPSSAHEAERCASSPPRTADADAESNSVSNPAPRATAYADSCASSSPPRAAAAGAPADPQLCGSYASDIYTYLRSLEVEPQRRSRPDYIEAVQADVTAHMRGILVDWLVEVAEEYKLVADTLYLAISYVDRFLSVNALGRDKLQLLGVASMLIAAKYEEISPPHPEDFCYITDNTYTKEELLKMESDILKLLKFELGNPTIKTFLRRFTRSAHEDKKRSILLMEFLGSYLAELSLLDYGCLRFLPSVVAASVMFVARLTIDPNANPWNMKLQKTTGYKVSELKDCIVAIRDLQLNRKFPSLTAIRDKYKQHKFKCVSTLLPPVVVPTSYFEDLAE

SEQ ID NO: 235 - DNA, 1425 bp, Zea mays
atggcgggcaaggagaacgcagctcccgtgggggccctgggcgtggcggggccccggctcacgcgggccgcggcgaagcgcgcggcggcgatggcggcggagggtccggacgacgccaaacggaggcgggtggcgcttggggagctcccggcgctcgccaacaacgccgccctcgcaccgtctcgccccgtgaagccctcgaagcccgcgtccaggcccgcgaggcccggcgcgtcggaggcctgcgggcccgccgccgccgccgaggccgagcgctgcgcgtccttctccccgccgcgcgccgccgacgccgagtccaactccgcctcctactccccgccgcgcaccacagccgacaccgctttctccgcgccgccgcgcgccgccgacgccgagtccaactccgcctcctactccccgccgctcgccacagccgacaccgctttctccgcgccgccgcgcgccgtggcgcccgccgacctccagctctccgggtcctacgcctccgacatctacacctacctccgctccctggaggtactccgctccgctccccaatctttcgcatttccgcagattcgatgcatctgcgttgggtctcgtctgatccgatgcttgcttgctacggatttggtgcggcgggtgcaggtggatccgcagcggcggtccagatccgattacatcgaggcggtgcaggcggacgtcacggcccacatgcggagcatcctcgtcgactggctcgtcgaggtcgccgaggagtacaagctcgtcgcggacacgctctacctcaccatctcttatgtcgaccgcttcctctccgtcaacgcgctcggccgtgacaagctgcagctccttggcgttgcctccatgctcattgccgcgaagttcgaggagatcagcccgccgcacccggaggacttctgctacatcacagacaacacctacaccaaagaggagctcctcaagatggagagcgacatactcaagcttctcaagttcgagttgggcaatcctacaatcaagaccttcctgagacgtttcataagatctgcccatgaagacaagaagggctccatcttgttaatggaattcttggggagctacctcgctgagctgagtctactagattatggctgcctccggttcttgccatcagtagttgctgcttcagtcatgtttgttgctaggctgaccattgatccaaataccaatccgtggaacacaaagctgcagaagatgactggctacaaagtttctgaactcaaggattgcatcgtagccatacatgacttgcagctcaacaggaaatgtccatcattaacggcaattcgagacaagtacaagcagcacaagttcaaatgcgtgtcattgatcctcgtgcctgtcgtgatccctacttcatactttgaagacttagctgagtag

SEQ ID NO: 236 - protein, 474 aa, Zea mays
MAGKENAAPVGALGVAGPRLTRAAAKRAAAMAAEGPDDAKRRRVALGELPALANNAALAPSRPVKPSKPASRPARPGASEACGPAAAAEAERCASFSPPRAADAESNSASYSPPRTTADTAFSAPPRAADAESNSASYSPPLATADTAFSAPPRAVAPADLQLSGSYASDIYTYLRSLEVLRSAPQSFAFPQIRCICVGSRLIRCLLATDLVRRVQVDPQRRSRSDYIEAVQADVTAHMRSILVDWLVEVAEEYKLVADTLYLTISYVDRFLSVNALGRDKLQLLGVASMLIAAKFEEISPPHPEDFCYITDNTYTKEELLKMESDILKLLKFELGNPTIKTFLRRFIRSAHEDKKGSILLMEFLGSYLAELSLLDYGCLRFLPSVVAASVMFVARLTIDPNTNPWNTKLQKMTGYKVSELKDCIVAIHDLQLNRKCPSLTAIRDKYKQHKFKCVSLILVPVVIPTSYFEDLAE

SEQ ID NO: 237 - DNA, 1074 bp, Zea mays
atggccgacatgcaaaactacgccgccccgccgctcctcacccacgctaccgccaagcgcaagcgtgtcgccctcaaccagctgcccacgctccccaacgccgtgctcggcgcgcacgacgaaggcggcggcggcgatgacaagcccgtcaagaagcagcacctcctccccgccgccaagcccgagcccaatgcagctcccgcgcctgccgccgccgcctctgatgtcgaggaggacccgcagctccgcaagccctacgcgtccgacatctactcctacctccgctccacggagtcgcaggccacgcgccgccccgccacggattacatcgcggcggtgcaggtcgacgtcacgcccaacacgcgggccatcctcgtcgactggctcgtcgatgtctccgaggagtacagattcgtctccgacacgctctacctcaccgtctcctacatcgaccgcttcctctccgccaacgcactcaacaggcagaagctgcagctcctcggcgtcgccgccatgctcatcgcatccaagcacgaggagatcagcccgctcaatgtggaggatttctgctacatcaccgataacacctacaccaagcaggaggtagttaagatggagagcgatatactgaatgtcctcaagtttgagatgggaaatcctactccaaaaacgttcctgaggatgttcaccagatttagcaaagaagacaccaagaagtatcgtagcctccagctggagttcctgggtagctacctttgtgagctcagcttgctagactacagcttgcttcgcttcttgccgtcacttgttgcagcctcggtgctgtttgttgcaaggctgacccttgatccacacacccatccctggagcaagaagatgcagacactaactggctacaagccatttgagttgaaggactgtgttgctgccatacatcatttgcagctcaaccggaaatattcatccatgatggcgacccgggataaattcaaggaacgcaggtttaagggtgtatcagctttgctaccacctgttgagatcccagcgtcatacttcgagaaactgaaggagtag

SEQ ID NO: 238 - protein, 357 aa, Zea mays
MADMQNYAAPPLLTHATAKRKRVALNQLPTLPNAVLGAHDEGGGGDDKPVKKQHLLPAAKPEPNAAPAPAAAASDVEEDPQLRKPYASDIYSYLRSTESQATRRPATDYIAAVQVDVTPNTRAILVDWLVDVSEEYRFVSDTLYLTVSYIDRFLSANALNRQKLQLLGVAAMLIASKHEEISPLNVEDFCYITDNTYTKQEVVKMESDILNVLKFEMGNPTPKTFLRMFTRFSKEDTKKYRSLQLEFLGSYLCELSLLDYSLLRFLPSLVAASVLFVARLTLDPHTHPWSKKMQTLTGYKPFELKDCVAAIHHLQLNRKYSSMMATRDKFKERRFKGVSALLPPVEIPASYFEKLKE

SEQ ID NO: 239 - DNA, 1275 bp, Zea mays
atggcggcgcgggcggctgacgagaacaggagaccggcggcagggaagcccgcgccaggcgtccgagacatggcgagccggcgcgcgctcacggacatcaagaacctcgtcggggctgccccgtacccctacgccgtcgccaagaagcccatgctgcagaagagcaaaagggacgaaaagcagccagcgttggcaagcagccggcccatgacaaggaaattcgccgcctccttggcgagcaagggccaacctgaatgtcagccgatcgtagctgatccagaacccgaagtttgtcaacagaaggaatcagtaggcgatggcaccgttgatattgacgtggaactctacgagctggtcgacggtagtgatagtgacatcgacatgggtgcgacagagaacaaggacattatgaacgaagatgaattgctcatggatattgacagtgcagactcggggaacccgcttgctgcaacagaatatgttaaagagctttacaccttttacagagaaaatgaggctaagagttgtgtaaggccagattacatgtccagccaacaagacataaactcaaagatgagagcaattctgattgactggctgattgaggttcactacaagtttgaactgatggatgagacgctctttcttatggtaaacataatagatagattcttggaaaaggaagtggttccaaggaagaagctacaactggttggagtcacagctatgctgctcgcttgtaaatatgaggaggtatctgttccagttgttgaggaccttgtgctgatatctgaccgtgcctacacaaaagggcaaattttagaaatggaaaagttgattctgaacacgctgcagttcaacatgtctgttccaacaccttatgtcttcatgaagaggtttctgaaagctgcagatgcagataaacagcttgagctagcgtcatttttcatgctggagctctgcttggtagaataccaaatgctgaattatcggccttcgcatctggctgctgctgcggtttatactgcacagtgtgctatcaatcgttgccagcactggacaaaggtctgcgagtctcatagcagatacactagcgaccaactcctggagtgctcgaggatgatggtagattttcaccagaaggctggaaccagtaagctcactggcgtgcacaggaagtacagtacctacaagttcggttgcgtggccaagattttgcctgcgcagttcctgctggagtcgggagggacaccgcctccttcaggtgcaaactag

SEQ ID NO: 240 - protein, 424 aa, Zea mays
MAARAADENRRPAAGKPAPGVRDMASRRALTDIKNLVGAAPYPYAVAKKPMLQKSKRDEKQPALASSRPMTRKFAASLASKGQPECQPIVADPEPEVCQQKESVGDGTVDIDVELYELVDGSDSDIDMGATENKDIMNEDELLMDIDSADSGNPLAATEYVKELYTFYRENEAKSCVRPDYMSSQQDINSKMRAILIDWLIEVHYKFELMDETLFLMVNIIDRFLEKEVVPRKKLQLVGVTAMLLACKYEEVSVPVVEDLVLISDRAYTKGQILEMEKLILNTLQFNMSVPTPYVFMKRFLKAADADKQLELASFFMLELCLVEYQMLNYRPSHLAAAAVYTAQCAINRCQHWTKVCESHSRYTSDQLLECSRMMVDFHQKAGTSKLTGVHRKYSTYKFGCVAKILPAQFLLESGGTPPPSGAN

SEQ ID NO: 241 - DNA, 1440 bp, Zea mays
atggagtgcgcaagggagttgcgggttcgctccacgtttacggcggcggccatggcgtccaagaagcaggtggggcctggaggcgcggttcccgctcaggaacagatgaacggcggcgatgccgccagactggtcaggaagccaatggatacatttccacagccagcggcggcaagaggccgtagggcacttgtcgacgttggcaatcttatgaatggccggccttctcttgtgaaccatcagaagcaagcggttgcggcagcggcaaccagtcataaaccactcaacgtcggcaacaagaagccacttgttcctcaggcagcagcaagaggcctgcgaccccttgccgacgttacgaatcttatgatcaaagaccgtgctgctcctgcaaatcgtcagaagcctgtggatgctgtgtttaacaggaacgggaaggcagtaaagctgaaggaatgcaaggtgaagcctgaagtcattgtgatcattccagattccgagaaggagaagaaaggcaaattccctggaggtcagagagtctgtaggagggtgccaacactttttgacaatttgacaaaatgcagcagggcctctgatgggattaccaccccgaagaagaaggatccatatgacattgatgcacctgattcttgcaatgagctggcagtcgttgaatatgttgaggacatttacagattctacaagagcactgagggcacctgccttcctctcagcagctacatgagctcacaggctgaaatcagtgagagaatgagagctatccttatcgactggattatcgaggtacagtacaggcttactctaatgccagagacactttacttgaccgtctacatcatcgaccagtacttatccatggagagtgtaccaagaaaggagctacagctcgtcggcataagtgccatgctgatagcaagcaagtacgaagagatatgggctccactggttaaggacttgatgtgcctctgtgacaacgcatttaccagagaccagattctgaccaaggaaaaggccatcctggacatgctccattggaacctgacggttccaacaatgtacatgttcattgttaggtacctgaaagccgcaatgtgtgacacagagcttgagaacatgacattcttctactccgagctggcattggtccagtacgcgatgctggtttaccctccatcggtgaccgcagccgctgccgtctatgctgccaggtctacacttgggatgaatccacagtggactgatattctggaacatcacactggcctagctgagccacagttactggactgcgctaggcggctgatcagcttccatgccctggctccggaaagcaagcaaaaggcggtgtacaggaaatactccaagcccaagctcggctccgtcgcgcttcaatcccctgacaagaagcttttgtcaggttga

SEQ ID NO: 242 - protein, 479 aa, Zea mays
MECARELRVRSTFTAAAMASKKQVGPGGAVPAQEQMNGGDAARLVRKPMDTFPQPAAARGRRALVDVGNLMNGRPSLVNHQKQAVAAAATSHKPLNVGNKKPLVPQAAARGLRPLADVTNLMIKDRAAPANRQKPVDAVFNRNGKAVKLKECKVKPEVIVIIPDSEKEKKGKFPGGQRVCRRVPTLFDNLTKCSRASDGITTPKKKDPYDIDAPDSCNELAVVEYVEDIYRFYKSTEGTCLPLSSYMSSQAEISERMRAILIDWIIEVQYRLTLMPETLYLTVYIIDQYLSMESVPRKELQLVGISAMLIASKYEEIWAPLVKDLMCLCDNAFTRDQILTKEKAILDMLHWNLTVPTMYMFIVRYLKAAMCDTELENMTFFYSELALVQYAMLVYPPSVTAAAAVYAARSTLGMNPQWTDILEHHTGLAEPQLLDCARRLISFHALAPESKQKAVYRKYSKPKLGSVALQSPDKKLLSG

SEQ ID NO: 243 - DNA, 1308 bp, Zea mays
atgcgtccgagacatggggagccggcgcgcgctcacggacatcaagaacctcgtcggggttgccccgaacccctgcgccgtcgccaagaagcccgtgctgcagaagagcagaagggacgaaaagaagacagcgttgccaagcagccggccgatgacaaggttaggacgcgtgctagctgttcttgcgctctggcatttcttggaggctttgatttgatctgggtattgctttggttgctcaggaaattcgtcgcctccttggcgagcaaagggcaacctgaatgtcagccgaccggagctgatccagaacccggagttgatcaacggaaggaaccaatcggcgatggcatcattgatatcgacgtggaactggacgagccggtcgacgatagtgattgtgacgtcgacatgggtgatgagacagagaacaaggacattatgaaccaagatgaatcgctcatggatattgatagtgcagactcggggaacccgcttgcagcaacagaatatgttgaagagctttacaagttttacagagaaaatgaggctaagagttgtgtaaaccctgattacatgtccagtcagcaagatataaatgcaaagatgagagcaattctgattgactggctgattgaggttcactacaagtttgaactgatggacgagacgctatttcttacggtaaacgtaatagatagattcttggaaaaggaagtggttccaaggaagaagctacaactggttggaatcacagctctgcttcttgcttgcaaatatgaggaggtctcagttccagttgttgaggaccttgtgctcatttctgaccgtgcctacacaaaagggcaaattctagaaatggaaaagttgattctgaacacgctgcaattcaacatgtctgttccaacaccttatgtcttcatgaagaggtttctgaaagcagcagacgcagataaacagcttgagctagtgtcatttttcatgctggagctctgcttggtagagtaccaaatgctgaattataggccttcacatctggctgccgctgcggtttatactgcacaatgtgctattaaccgttgccagcagtggacaaaggtttgcgagtcacatagcagatacactggcgaccaactcctggagtgctcgaggatgatggtagactttcaccagaaggctggaaccggcaagctcactggcgtgcacaggaagtacagtacctacaagttcgggtgcgcggccaagattttgcccgcgcagttcatgctggagttaggagggacagcaccgcctccttcaggtgcaatctaa

SEQ ID NO: 244 - protein, 435 aa, Zea mays
MRPRHGEPARAHGHQEPRRGCPEPLRRRQEARAAEEQKGRKEDSVAKQPADDKVRTRASCSCALAFLGGFDLIWVLLWLLRKFVASLASKGQPECQPTGADPEPGVDQRKEPIGDGIIDIDVELDEPVDDSDCDVDMGDETENKDIMNQDESLMDIDSADSGNPLAATEYVEELYKFYRENEAKSCVNPDYMSSQQDINAKMRAILIDWLIEVHYKFELMDETLFLTVNVIDRFLEKEVVPRKKLQLVGITALLLACKYEEVSVPVVEDLVLISDRAYTKGQILEMEKLILNTLQFNMSVPTPYVFMKRFLKAADADKQLELVSFFMLELCLVEYQMLNYRPSHLAAAAVYTAQCAINRCQQWTKVCESHSRYTGDQLLECSRMMVDFHQKAGTGKLTGVHRKYSTYKFGCAAKILPAQFMLELGGTAPPPSGAI

SEQ ID NO: 245 - DNA, 1371 bp, Zea mays
atgcctcccgccatgctcgcgccggtgcccaccaggccgcgctccaaccccttccgccgccgcagaggagctgctccgcgcctcctcgatcagactgcgacggctgcggcgaagcggcccgctgagtcgtccacctcggcttcctcctgcttctacagcgaggtgatctccaactccacctccctcgccgcgtttcagcacccagagaagaggcgtcggcgccaggacgcggacgcggacgaggcgcggccggccggctccgagtgctcggaggtgatcggcggcgcgagggtgcgccccgcagaggtcgaggcctccgagtcgtcgtgcctcggctccgtgctcgagtccgacctcgcctgccctgagcagctcgccgacaacgctgaggcgatcgagtactcctccgcgtgcgatgagctgaccccgtcggagcccgatgaggaggaggtgctcagcggttccagcggctgcgcgctgtactccctcagccccctgatcagctccccattgaccgaagatgacaacgacgacgcgccctctgcgacattctccctcttcctcgacttcgccaagcagttcgtcccctgcgtgcaccccaaaacgtgcgccgtcaccagtaccgctctcgatctcctgacggggaggcggtttgaggacttagacgacgaggagacctacgagcggttccggcggcgcgagcggcgtgaggcagttgcgcgcgactacactgaggtgtacaggtccatacccgacagctacggccctctcgtcgtggagcaacgtgtcttcatggtggactggatcattgagcattcacgtctgatgaagctccagccagttacaatgttcatggggattggattgatggaccgcttcttgacacaagggtatatgaaaggtttggaaaaccttcagttgctggccattgcctgcatcaccctggctacccgcatcgaagagaaccagccatacaattgcgtccttcaaaagacttttaaatttgggaccattaacacctacagccagagtgaagttgttgccatggagtggctggttcaggaggtcctcaacttcaagtgttttgtcacaacacctcaccatttcctatggttctatctgaaggctgcaaatgctgatgacagtgtagcggacctggcaaaccacctggccttcctctcacttgagaaccctaagcagctctccttctggccctcgactgtggcagctgcagtggtagctcttgcttgccttgccacaggcaaggagccctcatgccatttggtgatggagactcacatgaggacgcaggacgatgatctaccagaatgcctaatgagcctcgagtggctgatcgagtgcgtcccgtga

SEQ ID NO: 246 - protein, 456 aa, Zea mays
MPPAMLAPVPTRPRSNPFRRRRGAAPRLLDQTATAAAKRPAESSTSASSCFYSEVISNSTSLAAFQHPEKRRRRQDADADEARPAGSECSEVIGGARVRPAEVEASESSCLGSVLESDLACPEQLADNAEAIEYSSACDELTPSEPDEEEVLSGSSGCALYSLSPLISSPLTEDDNDDAPSATFSLFLDFAKQFVPCVHPKTCAVTSTALDLLTGRRFEDLDDEETYERFRRRERREAVARDYTEVYRSIPDSYGPLVVEQRVFMVDWIIEHSRLMKLQPVTMFMGIGLMDRFLTQGYMKGLENLQLLAIACITLATRIEENQPYNCVLQKTFKFGTINTYSQSEVVAMEWLVQEVLNFKCFVTTPHHFLWFYLKAANADDSVADLANHLAFLSLENPKQLSFWPSTVAAAVVALACLATGKEPSCHLVMETHMRTQDDDLPECLMSLEWLIECVP

SEQ ID NO: 247 - DNA, 1380 bp, Zea mays
atgcctcccaccatgctcgcgccggtgcccaccaggccgcgctccaaccccttccgccggcgcagaggagctgctccgctgcttctcgatcagacttcggcgaagcggcccgctgagtcgtccacctcagcctcatcctgcttctacagtgaggtgatctccaactcctccacatccctcgccccgtatcagcgcctggagaagaggcatcgacgccaggacacagacgcgggcgaggcgcggccggctggctccgagtgctcggaggtgatcggcggcgcgagggtgcgccccgccgaggtcgaggtctccgaatcgtcctgccctgtctccgtgctcgagtccgacctcgcctgcccgaagcagctcgccgacgacgctgaggcgatcgagaaatcctccgcgtgcgatgagctgaccccgtcgtcggagcccgatgaggaggaggtgctcagtgatcccagccactcggggtactcccccagtcccctgatcagctccccattgaccgaagatgacagcgacgacgcgccctctgcgaccttctccctctttctcgacttcgccaagcagttcgtcccctgcttgcaccccaaaccgtgcaccgtcaccagttccactctcgatctcctgacggggaggcggtttgaggacttggacgacgaggagagctacgagcgcttccggcggcgcgagcgacgcgaggcagttgcgcgcgacttcactgaggtgtgcagctccacctccatacccgacagctaccgccctctcgtcgtggagcaacgtgtcatcatggtgaactggatcatccagcattcacgtctgatgaagctccagccagttacaatgttcatgggaattggattgatggaccgcttcttgacacaagggtatatgaagggtttgagaaaccttcagttgttgggcattgcctgcatcaccttggctacacgcatcgaagagaaccagtcatacaattgcgttcttcgaaagacttttcaagttgggatcaatatctacagccagagtgaggttgttgccatggagtggctggttcaggaggtcctcaacttcaagtgttttgtcacaacaacccatcatttcctatggttctatctgaaggctgcaaatgctgatgacagggtagcggacctggcaaactacctggccttcatctcacttcggaaccatgagcagctctccttctggccctcgactgtggcagctgcagtggtagttcttgcttgccttgccacaaacaaggagtcctcatgccatttggtgacggaggtgaacacccagactcacatcaggacgcaggatgatgatctaccagaatgcctaatgagcctcgagtggctgatcaagtacgtctcgtga

SEQ ID NO: 248 - protein, 459 aa, Zea mays
MPPTMLAPVPTRPRSNPFRRRRGAAPLLLDQTSAKRPAESSTSASSCFYSEVISNSSTSLAPYQRLEKRHRRQDTDAGEARPAGSECSEVIGGARVRPAEVEVSESSCPVSVLESDLACPKQLADDAEAIEKSSACDELTPSSEPDEEEVLSDPSHSGYSPSPLISSPLTEDDSDDAPSATFSLFLDFAKQFVPCLHPKPCTVTSSTLDLLTGRRFEDLDDEESYERFRRRERREAVARDFTEVCSSTSIPDSYRPLVVEQRVIMVNWIIQHSRLMKLQPVTMFMGIGLMDRFLTQGYMKGLRNLQLLGIACITLATRIEENQSYNCVLRKTFQVGINIYSQSEVVAMEWLVQEVLNFKCFVTTTHHFLWFYLKAANADDRVADLANYLAFISLRNHEQLSFWPSTVAAAVVVLACLATNKESSCHLVTEVNTQTHIRTQDDDLPECLMSLEWLIKYVS

SEQ ID NO: 249 - DNA, 3150 bp, Zea mays
atgatgactgttcccatggatagtgctagcgcagccccatcctccacgcgggaccttgccgagcgtctccttactaggaataatgaacttgaagaccagcttcgtaagtccgcacaatccaaagtcccatcagatcccaacatatggcttcagatgcgtgacaactttgagaagataattctcatagatcacgacctctctgaacagagagatgtagagtatctcctatggcagttgcattacaaaagaattgaggacttcaggaggaacattagtgcagctagctcacttgcatctcagagtgggaagagcaacactaacccagatcgagtcaagagaattaaatcagccttcaaaagcttcctttcagaagcaactggcttctatcatgacttgatgttaaagatcaaatcaaattggggccttccactcaattactttccagacagccttgacaatgcaaacaactctgtgcgagatgacatgaaaacagttcaattgaagaaaggtttgatttcatgccatcggtgtctgatatatttgggagatcttgctcgttacaagagtttgaatggtgatggtgattctgctagtcgtgaatacacagcggcttctagttactacaaggaggcagcttctatctatccttccagtggcaaccctcatcatcagcttgctatactagcttcttactccggcaacgaggtggtggctgtttataggtacttccgaagcttagctgcagacactccttttgccactgcacgggacaacttgattattctttttgaaaagaatcgccaaagctatggacagctgccagacaacagcaaagttcctagcactaagacattacccccacggccatctgggtggggccgaggacggggagaagtaaggtttcaaccaaaagatgttaatgcagaaacagctgaaagggaacgcgagtgcaataatggtgatacattgaagaccttctatataagattcgtcaggctcaatggaattcttttcacgaggaccagtttggaaacattcggggagctgttttcttcagttagcaatgatttgcagattcttctttcttctggtcttgaagaggaccttaatttcggttctgatgctgcagaaaatgcattggctgctgttagacttactgtcatccttatattcacagtgcacaatgtaaataaagagcctgataggcagtcttatgctgaaattgtgcaacgcagagtactgctccaaagtgcgtttacggctgcttttgactttgttggacgaattctcagaaggtgttcagagctccatgatattgcatcaagcttctatctgccagccattttggtctatattgaatggctggcgtcccatccagagttggctgttgattcagagatggaggaaaagcatgcaaatgccaggtctttcttctggagccaatgcatctcatttatgaataagttgatccttaccaaccttgcatctgtgaatgatgatgatgacgaggcttgcttttctaatatgagcatttatgaggagggtgaaactggcaacaggtttgccctttgggaagatcttgaattgagaggttttctgcccttgcttcctgcacataccattttggatttctcaagcaaacacacatttggaagcaccaaggagaagaaagcacgggttcagcgaatttttgctgcaggaaagtcactgcttaactttgttcagattgatcagttgagaatttattttgattcatcatcgaagaagtttgttatggccaagaaccctcctgtttctaaaactaacacccctcttcacgaatctcctgatgcacttaaaacaagtggcactgaaatggattatgaggctgctagaagatttgattcagtttcttctaatatgggcacactgcagtctaaagtgcagttttgtcctgatggtgacgatgatgaagaaattgttttcaagccaacagcttccgaaaagtttccgaaagctccttcagatctgttggttaatggatacactcatcctgtacctatgtctactgctggctggccaaccaatgctagtttagtgcctgttcagagcactggatcaatgactgcaactggttggccacccaatggtgggtcaaatgcttttccaagtactgcatctctatcagctgctggtaattacaacattaaccagtcgcttcccaggtcttccgttggttgggctgtcaatggtgagcaaagtgttattcctagcattgctccaagatttgaactcgtgcagcctgttgaagagcctgtttccagctggacaagcagtggtgcacagcatgttggtactcagcacaagcacacaggtttaactttcccagatgttgtgtctgaaccacttgtatctgcatcaatggttcaacgtttcagtagcactgattattcgaaatttctcagtgaacaagaaatgctcttagtgaatggactgaatactgtcaacttaactggaaatggctatttaaagcagagactgcagcctggattgagtggtttacagtctatggggtattcatctcagacacctattgaacctggtggtaccactgcaaactcgatgcataatcatctgaaaattactggagagaatgtgccctctacacttgattcagttgtaccttcaatagctccattaggtggcatgccaatgaaattcacagaagcgccactaactgcttcaaagaagaaccctgttagtcgtccatcaaagcctgttgggccacctccaggatttgatcatgtagccccaaagcgccaagatgattctattccagttgaaaaactgcagatcccacaggttgatgattacagctggctagatggttatcagcaatcgattgatcatgttcacaacttaagaactgtttattctggtgtcagtgacagcactgcatttgccactccattccccttccctgggaaacaacagttatctgggatgcatgcacaaggggctacaaatgaaaagacatggcaagatttccgtctttttgagccttcaaaacagaacatgctccaaaattaccaccaaagaaatcagcaaaatggtcaaatagctgaacaagagccagcaaattctgtctggtctagcagttaccatgtgtga

SEQ ID NO: 250 - protein, 1049 aa, Zea mays
MMTVPMDSASAAPSSTRDLAERLLTRNNELEDQLRKSAQSKVPSDPNIWLQMRDNFEKIILIDHDLSEQRDVEYLLWQLHYKRIEDFRRNISAASSLASQSGKSNTNPDRVKRIKSAFKSFLSEATGFYHDLMLKIKSNWGLPLNYFPDSLDNANNSVRDDMKTVQLKKGLISCHRCLIYLGDLARYKSLNGDGDSASREYTAASSYYKEAASIYPSSGNPHHQLAILASYSGNEVVAVYRYFRSLAADTPFATARDNLIILFEKNRQSYGQLPDNSKVPSTKTLPPRPSGWGRGRGEVRFQPKDVNAETAERERECNNGDTLKTFYIRFVRLNGILFTRTSLETFGELFSSVSNDLQILLSSGLEEDLNFGSDAAENALAAVRLTVILIFTVHNVNKEPDRQSYAEIVQRRVLLQSAFTAAFDFVGRILRRCSELHDIASSFYLPAILVYIEWLASHPELAVDSEMEEKHANARSFFWSQCISFMNKLILTNLASVNDDDDEACFSNMSIYEEGETGNRFALWEDLELRGFLPLLPAHTILDFSSKHTFGSTKEKKARVQRIFAAGKSLLNFVQIDQLRIYFDSSSKKFVMAKNPPVSKTNTPLHESPDALKTSGTEMDYEAARRFDSVSSNMGTLQSKVQFCPDGDDDEEIVFKPTASEKFPKAPSDLLVNGYTHPVPMSTAGWPTNASLVPVQSTGSMTATGWPPNGGSNAFPSTASLSAAGNYNINQSLPRSSVGWAVNGEQSVIPSIAPRFELVQPVEEPVSSWTSSGAQHVGTQHKHTGLTFPDVVSEPLVSASMVQRFSSTDYSKFLSEQEMLLVNGLNTVNLTGNGYLKQRLQPGLSGLQSMGYSSQTPIEPGGTTANSMHNHLKITGENVPSTLDSVVPSIAPLGGMPMKFTEAPLTASKKNPVSRPSKPVGPPPGFDHVAPKRQDDSIPVEKLQIPQVDDYSWLDGYQQSIDHVHNLRTVYSGVSDSTAFATPFPFPGKQQLSGMHAQGATNEKTWQDFRLFEPSKQNMLQNYHQRNQQNGQIAEQEPANSVWSSSYHV

SEQ ID NO: 251 - DNA, 3174 bp, Zea mays
atgatgaccgttcccatggatagtgctagcgcagccccgtcctctgcgcgggactttgctgagcgtctccttactaggaataatgaacttgaagatcagcttcgcaagtccgcacaatccaaagtcccatcagatcccagcatatggcttcagatgcgtgacaactttgagaagattattctcatagatcatgacctatctgaacagaaagaggtagagtatctcctatggaagttgcattacaaaagaattgaggacttcaggaggagcattagtgctgcaagctcagctgcatctcagagtgggaagagcaacgctaatccagatcgagtcaagagaattaaattaaccttcaaaagcttcctttcagaagcaactggcttctatcacgacttgatgttaaagatcaaatcaaatttgggccttccactcagttactttccagagggcatcgacaatgcaaacaactctgcgcgagatgacaagacaacagtgcagttgaagaaaggtttgatttcatgccatcgctgcctgatatatttgggagatcttgctcgttacaagagctcgcaaggtgatggtgattctgctagccgtgaatacgcagcggcatctagttactacatggaggctgcttctatctatccttccagtggcaaccctcatcatcagcttgctatactagcatcttactcaggcaacgaggtggtagctgtttataggtacttccgaagcttagctgcagatactccttttaccactgcacgtgacaacttgattattctttttgaaaagaatcgccaaagctatagacagctgccagacaacaacaaagttcccagcgctaaggcattacccccacggctatctgggaggggacaaggacggggagaagtaaagtttcagccaaaagatgttaacgcagaagcagctgaaagggaacaggagtgcaatgttcgtgatacattgaaggccttctatatacgatttgtcaggctcactggaattcttttcacgaggaccagtttggaaacatttggggagctgttttcttcagttagcaatgatttgcagattcttctttcttccggtcttgaggaggaccttaatttcggttctgatgctgcagaaaatgcattagctgctgttaggcttactatcatccttatattcacagtgcacaatgtaaataaagaacctgatagccagtcatattctgaacttgtgcaacgcagagtactgctccaaagtgcgtttacggctgcttttgattttgttggacgaattctcagaaggtgttcagaacttggtgatatcacatcaagcttctatctgccagccattctggtctacatcgaatggctggcgtcccatccagagttggctattgactcagagatggaggaacagcatgcaaatgccagatctttcttctggaaccaatgtatctcatttatgaataagttgatccttaccaaccttgcttctatggaggacaatgacgatgaggcttgcttttctaatatgagcatttatgaggagggtgaaactgggaacaggcttgccatttgggaagatcttgaattgagaggttttttgcccttggttcctgcacataccattttggatttctcaagcaaacacacatttggaaatgttggaagcaccaaggagaagaaagcacgggttcaacgaatttttgctgcaggaaagtcactgctgaactttgttcagattgatcagttgaggatatattttgatccatctttgaaaaagtttgtcttggccaagaactctcctgtttctagaactaacacccctcttcatgaatctcctgatgcacttaaaacaaatgggactgaaatggatcacaaggctgctagaagatttgattcagtttcttctaatgtgggctcactgcagtctaaagtgcagttttgtcctgatggtgatgatgaagaagaaattgttttcaagccaacagcttatgagaagttttcaaaagtttcttcagatctgtcagttaatggatacgtccatcctgtaccagtgtctgctgctggtgggccaaccaatgctagtttagtgcctgttcagaacactgcatcaatgtctgcaactcgtttaccatccaatccacatgcaactggtttgccatccaatggtgggtcacttccaagtactgcatctctatcagctgctggtaattacaacactgatcagtcgcttcccaggtcgtctgttggttggactgattgggctgtcaatagtgagcaaaatgttactcctagcattgctccaagatttgaactcatgcagtctgttgaggagcctgtttccagctggacaagcagtggggcacagcatgttggtcctcagcacaagcacacaggtttaactttcccagatgttgtctctgaaccatgtgtatctgcatcaatggttcaatgttttagtagctccgattattcgaaatttctcagagaacaagaaatattcttaatgaatggactgaagactgtcaacataactggaaatggctatctagagcagagattgcagcctggattgagtggtttacagtctatgggttattcatctcagatacctattcaacctggtggtaccactgcaaacctgatgcataatcatgtcaaaattactggagagactgtcccctctacacttgattcagttgtaccttcaatagcaccatcaggtggcatgccaatcaaacttacagaagcaccactaactgcttcgaagaagaaccctgttagtcgtccatcaaagcctgttggaccacctccaggatttaatcatgtaaccccaaagcgtcaagatgattctattccggttgaaaaactgcagaacccacaggtcgatgattacagctggctagatagctatcagcaatcgattgatcatgttcacagcttaagaactatttatcctggtgtcagtgatactagcactgcatttgccactccattctctttccctgggaggatacacacacaagggaccaatgaaaagacttggcaagatttccacctttttgagccttcaaaacagaacatgttccaaacttaccaccaaagaaatctgcaaagtggtcaaatggatgaacaagagccagcaaattctatctggtctagcagttaccatgtgtga

SEQ ID NO: 252 - protein, 1057 aa, Zea mays
MMTVPMDSASAAPSSARDFAERLLTRNNELEDQLRKSAQSKVPSDPSIWLQMRDNFEKIILIDHDLSEQKEVEYLLWKLHYKRIEDFRRSISAASSAASQSGKSNANPDRVKRIKLTFKSFLSEATGFYHDLMLKIKSNLGLPLSYFPEGIDNANNSARDDKTTVQLKKGLISCHRCLIYLGDLARYKSSQGDGDSASREYAAASSYYMEAASIYPSSGNPHHQLAILASYSGNEVVAVYRYFRSLAADTPFTTARDNLIILFEKNRQSYRQLPDNNKVPSAKALPPRLSGRGQGRGEVKFQPKDVNAEAAEREQECNVRDTLKAFYIRFVRLTGILFTRTSLETFGELFSSVSNDLQILLSSGLEEDLNFGSDAAENALAAVRLTIILIFTVHNVNKEPDSQSYSELVQRRVLLQSAFTAAFDFVGRILRRCSELGDITSSFYLPAILVYIEWLASHPELAIDSEMEEQHANARSFFWNQCISFMNKLILTNLASMEDNDDEACFSNMSIYEEGETGNRLAIWEDLELRGFLPLVPAHTILDFSSKHTFGNVGSTKEKKARVQRIFAAGKSLLNFVQIDQLRIYFDPSLKKFVLAKNSPVSRTNTPLHESPDALKTNGTEMDHKAARRFDSVSSNVGSLQSKVQFCPDGDDEEEIVFKPTAYEKFSKVSSDLSVNGYVHPVPVSAAGGPTNASLVPVQNTASMSATRLPSNPHATGLPSNGGSLPSTASLSAAGNYNTDQSLPRSSVGWTDWAVNSEQNVTPSIAPRFELMQSVEEPVSSWTSSGAQHVGPQHKHTGLTFPDVVSEPCVSASMVQCFSSSDYSKFLREQEIFLMNGLKTVNITGNGYLEQRLQPGLSGLQSMGYSSQIPIQPGGTTANLMHNHVKITGETVPSTLDSVVPSIAPSGGMPIKLTEAPLTASKKNPVSRPSKPVGPPPGFNHVTPKRQDDSIPVEKLQNPQVDDYSWLDSYQQSIDHVHSLRTIYPGVSDTSTAFATPFSFPGRIHTQGTNEKTWQDFHLFEPSKQNMFQTYHQRNLQSGQMDEQEPANSIWSSSYHV

SEQ ID NO: 253 - DNA, 684 bp, Zea mays
atgcctgagtccagggacggcaggagtgaggacctagctgacctttctggtggtgttggtggtggagggttctttatcaggagggtggcctcgccgggagccctagcggtgaggggtgtcaggaagccgttggcgcggcgttatatttcaccctcgaggaacaaggagaacctgctgccggtttgggcgttgagggtcacaccgacaaagaggagcccgcttcctggatggtaccccaggacgccgctccgtgatattacggccattgcaaaggctattcagagaagtcgttcaaggattgctgcagctcagcagcgaagccaaaggatcgagcagtcttcacaatctgtgaacgtgactactccagcacaagcagagcaggatgctcacattgctgaagcctcccatgctgttgcatctggctccggctcaactgaaagagaagctgtagcaaaccctgctactgttttggctgatgacaatttgaatgtgtcttctttggcagcagaaggctcattgaatactccatccaaaccaatggatcctgcccttgctgacaagaaactttccggttcaatagagaaggtagagaagttggtgaggaaaaacctgaagcgaacatcgagggctgcccaggcctccaggagggccacccaaaggcgcaatcttatgtccatgcgatga

SEQ ID NO: 254 - protein, 227 aa, Zea mays
MPESRDGRSEDLADLSGGVGGGGFFIRRVASPGALAVRGVRKPLARRYISPSRNKENLLPVWALRVTPTKRSPLPGWYPRTPLRDITAIAKAIQRSRSRIAAAQQRSQRIEQSSQSVNVTTPAQAEQDAHIAEASHAVASGSGSTEREAVANPATVLADDNLNVSSLAAEGSLNTPSKPMDPALADKKLSGSIEKVEKLVRKNLKRTSRAAQASRRATQRRNLMSMR

SEQ ID NO: 255 - DNA, 2349 bp, Zea mays
atgcagatggacgtagagacggtgcaggcgggtcctgcgctcgcggctcatctgcagctgcaggcatcgccgaagccacaggtgaagaagtactacttcaagaagaagacgagcagtagtcatagcagaaatggtaaggatgatgtcaaccacgactccacgattcaacccaggtcgcccctgagcagacagagcctgaccttcgacgccatccccacataccacgctggagctttctacgagatcgaccacgataaattgccccctaaatccccaatccatctgaaatccatacgggtggttaaggtgagcgagtgcacgaacctggacatcacagtgaaattcccgtcccttcaggcgctgcgcagcttcttctcctcctacccggcacccggcaccggaccggaactagacgagcgcttcgtcatgagcagcaaccacgccgcgcgcatcttgcgccgccgagtgaccgaggaggagctcgagggcgaggtgcagcaggacagcttctggctcatcaagccccggctctatgacttcgccgcacctcagcaggtgccgtcacggacattgtgcctgccgccgccgcccgctccaccggcggctacgctggggctaacagctgactcctgtctactcaccacgttgaagtgcgatggcgccgggtggggtatgaggcgccgcgtcaggtacattggacggcatcgtgatgaagctcccaaggaggctagtgttgatggctacgacacagagtccagtgtcagggaggtgcagcagcctccagcgacgcaggaagttaaaaggagcgaaagaaactgtaaaagaaagcgggaggcggaagcgagcagcaaggacaacaacggagacgagggcaagaagaataacaaggttcagggcgccagcaagaagatttcaaaaaaggcgaagaagcggaccgtcgaatccaaggacggtgaccctcggcacggcaaggaccggtggtcagccgagcgctacgccgcagcagagaagagcctgctcaacatcatgcgctcccgagacgcacggttcggcgcaccggtgatgcggcaggtgctgcgggaggaagcccgcaagcacatcggcgacaccggcctccttgaccacctgctcaagcacatggctggccgggtgccggaaggcagcgttcaccggtttcgtcgccggcacaatgcggatggtgccatggagtactggcttgagccagccgagcttgctgaggtacggaaacaggccggtgtatctgatccatactgggtgccaccgccgggatggaaaccaggtgatgatgtgtccctcgtcgccggcgacattctagtcaagaggcaggttgaggagctcaccgaggaggtcaatggcgtaaaaaggcaaatggagcagttattgtgcaaggatgatggggacttcggtgcagagagagactacagttcattgaaagagaagtaccagcgtgctgtgagggctaatgaaaagcttgagaagcaggtgctctgtttgaaggacatgtgtgagaatgtggttcagatgaatggtgagctgaagaaggaggtgtcatccttcaaggaaaagtacgagcatatagctgacaagaatgataagttagaggagcaggttacctacctctccagctccttcctttctttcaaggatcagctggtagtggctctgaagctggaactggctccaagtgaagctgttccccgcacagcactgttcgttgcttccggtgagcagatgaccggcaccgtcatccaaggcggccaagacagggcggaaaggaagagcagcttccgcgtctgtaagccacagggcaagttcctgttgccgagcatggcgtctggcatgaccatcggcaggggcgccagcagcacctgcccggccgccgccacgccaggcccggggatccctcgcagcaccagtttccccagtatgccgggcctcccgcggtcgtcgcgaggcccagttgaggtggtggcggcggcgtccggcctggacgagcacgtgatgtttggcgcccacttctctacgccgccctcggcgtcgtccaccaacgacgctgccaagctgcagctgtccctgcccagcccgaggtcgcccctgcagccgcagaagctgtttgacactgttactgctgctgcttctgggtttagtccccaaaagctgatgcatttctccggcctgactcgacgcgatgtggacacctcgtcgtcatcgtccggggcctgcggttccggcctgctagaggggaagagggtcctgttcgatgcagacgccggcgggatcagcgcggtgggaaccgagctggccctggctactccatcctactgctga

SEQ ID NO: 256 - protein, 782 aa, Zea mays
MQMDVETVQAGPALAAHLQLQASPKPQVKKYYFKKKTSSSHSRNGKDDVNHDSTIQPRSPLSRQSLTFDAIPTYHAGAFYEIDHDKLPPKSPIHLKSIRVVKVSECTNLDITVKFPSLQALRSFFSSYPAPGTGPELDERFVMSSNHAARILRRRVTEEELEGEVQQDSFWLIKPRLYDFAAPQQVPSRTLCLPPPPAPPAATLGLTADSCLLTTLKCDGAGWGMRRRVRYIGRHRDEAPKEASVDGYDTESSVREVQQPPATQEVKRSERNCKRKREAEASSKDNNGDEGKKNNKVQGASKKISKKAKKRTVESKDGDPRHGKDRWSAERYAAAEKSLLNIMRSRDARFGAPVMRQVLREEARKHIGDTGLLDHLLKHMAGRVPEGSVHRFRRRHNADGAMEYWLEPAELAEVRKQAGVSDPYWVPPPGWKPGDDVSLVAGDILVKRQVEELTEEVNGVKRQMEQLLCKDDGDFGAERDYSSLKEKYQRAVRANEKLEKQVLCLKDMCENVVQMNGELKKEVSSFKEKYEHIADKNDKLEEQVTYLSSSFLSFKDQLVVALKLELAPSEAVPRTALFVASGEQMTGTVIQGGQDRAERKSSFRVCKPQGKFLLPSMASGMTIGRGASSTCPAAATPGPGIPRSTSFPSMPGLPRSSRGPVEVVAAASGLDEHVMFGAHFSTPPSASSTNDAAKLQLSLPSPRSPLQPQKLFDTVTAAASGFSPQKLMHFSGLTRRDVDTSSSSSGACGSGLLEGKRVLFDADAGGISAVGTELALATPSYC

SEQ ID NO: 257 - DNA, 981 bp, Zea mays
atgggatgcttccattccacggccaagcggcagcatcctggctacgaggaccctgtgcacctcgcctcccagacctcctttagtgttagtgaggttgaggctctattcgagctgttcaagagcataagtcgttcagtgattgacgatggcctgatcaacatggtatattctattactcatctctgtattccttgctatattgtcagttttgtgtatgaacatcaaaacaagccactcagacgtagaaaacttgacatacattactccattccgaaggacaatccttcggagaaggatattaaccaggggatgcttgttatatttaatgttgacccctctataacaaacaatgatatccatcagatatttagcgaatatggtgacataaaagagattcatgatgcaccgcaaaagggccatcacaaaattatagaattttataatgtcagagcagctgaaggtgcagctcgtgctttaaacaggagtgatcttgctggcaagaaaataaaactggagactggccgtctgagtggtgctagacgttcaacacaacacatgtccaaggagttggggttggaagaatttggcgtatacaacctgggcagtccaagcacaaatagcccttcattgccttcattgggtatgagcctgtcctctcccattggaattgcttctgctgcaactcatagtaaccaggctccccttggtgagatcagccactctcttagtcggatgaataggcatgtgaattatggttttcaaggcttgggtgctattcatccccattctcttcctgatgttcacaatggagcaaataatggcaccccttacaatctgaacaccatcacacctgttggtgtcaataagaactcaagaacagctgaagcagttgacagcagacatcttcataaagtgggttctggcaatctcaatgggcactcatttgatcgtgccggtgaaggagttgtaaagtggtggtga

SEQ ID NO: 258 - DNA, 1038 bp, Zea mays
atgggatgcttccattccacggccaagcggcagcatcctggctacgaggaccccgtgcacctcgcctcccagacctcctttagtgttagtgaggttgaggctctattcgagctgttcaagagcataagtggttcagtgattgacgatggcctgatcaacaaggtaaattctattagtcatctctgtattccttgctatattgtcagttttgtgtatgaacatcaaaacaagccactcagacgtagaaaacttgacatacattactccattccgaaggacaatccttcggagaaggatattaaccaggggatgcttgctatatttaatgttgacccctctataacaaacaatgatatccatcagatatttagcgaatatggtgacataaaagagattcatgatgcaccgcaaaagggccatcacaaaattatagaattttatgatgtcagagcagccgaaggtgcagctcgtgctttaaacaggagtgatcttgctggcaagaaaataaaactggagactggccatctgagtggtgctagacgttcaacacagcacatgtccaaggagttggggcaggaagaatttggcatatacaacctgggcagtccaagcacaaatagcccttcattgccttcattgggttcatctaatatagtagcaatgacatcttgtggacgtgaaaatgggagtatgcatggtttgcattctggacttctcacatcaatgagcccgttcagagaggcttcatttctgggtctatcatctaccctaccacagagcctgtcctcgcccattggaattgcttctgctgcaactcatagcttgggtgctattcatccccattctcttcctgatgttcacaatggagcaaataatggcaccccttacaatctgaacaccatcacacctgttggtgtcaataagaactcaagaacagctgaagcagttgacaacagacatcttcataaagtgggttctggaaatctcaatgggcactcatttgatcgtgccggtgaaggagttgtaaagtggtggtga

SEQ ID NO: 259 - DNA, 1995 bp, Zea mays
atggagggtgggggagggagtggaatgggtgggttcccggaagccacgggtaaccttctcgatgccgcagctcaggagttccaccctacggtctgtgccccctatcctctacagccgcttccgcaacagctatactgcccccacccatatccagccatgccggtgcctccgccgccgcaaatagccatgttacagccagtgcctccgatggcgatggccatggcgccgcagccggggtacaccttgccaacgacgacgccggtggtcaatggcccgtcgagccgcgtcgtggtgctgggccttgtcccgccgcacgcgcaggaggccgacgtggcgcaggcgatggcgccattcggcgcgatccgctcggtcgacgcgtgcgcggtggcgtccgagggcgtggccaccgtccatttcttcgacatccgcgccgccgagctcgccttgacctgtgtccgcgagcagcacatgcgccagcagagccgcctcgggcagctctacgcggcggccgccgtagccccggcgtgggctcctgcaccgacgccccaggcctgggactggccccaccccaacgacgacggccgcggcctcgtcctcgggcacgccgtgtgggcccacttcgccaccggcgccgacgacggcgacaaccgcggctccctggtggtcctgagccccctgcccggcgtctcggtcgctgacctccgccaagtcttccaggccttcggggacttgaaggatgtgagggagtcggcgcagcggcccagccacaagttcgtggacttcttcgacacgcgcgacgccgcgcgcgcgctcgccgagctcaacggccaggagcttttcggccgccgcctcgtcgtcgagttcacgcgcccttccggccccgggccccgcaggcgcgggtacgcaccccaccagcaccggcccaccgcgccgactccgccgaggcttcaagcgacgtggcgaccgtcccaaccgacgtcgtctcagccgccggcatcctcgtcgtcgtccggttccgtaagggcgagggaaggagtggtgcttctgaggaggagctcctgtaagtctagcgcgggcagcgaccagtcgtccaagggaggcaatgccggaacgagccatgagcgcaagaccaagggcggcaagatcgtggtggcggcggcggcggcatcctcgtcgaccccgacagcgtccgggaagcaaacccagaaaggcgtcgggagcagcggcggcgggagctggaaaggacgaaagagcgggtgggaggcgcgcttcctgttcaaggagcccgaggccggcggcggcgccgacacgcaagcaacgccggcttcggagatggatacgaggaccaccgtcatgatcaggaacataccgaacaagtacagccagaagctgctgctcaacatgctggacaaccactgcatccaatccaacgagtggatcgtggcgagcggcgaggagcagcccttctccgcctacgatttcgtctacctccccatagatttcaacaacaagtgtaatgtgggctacggcttcgtcaacctgacatcgccggaggctgccgtgcggctgtacaaggcgttccacaagcagccatgggaggtgtacaactcgcgcaagatctgccaagtgacatacgcgcgcgtacaaggcctggaagcgctgaaggagcacttcaagaactccaagttcccgtgcgacagcgacgagtacctgcccgtggcgttctcgccggcgcgcgacggcaaggagcttacggatccagtgcccatcgtgggccgctcgcccgcggcgtcgtccgcgtcgtcgcctcccaagagccgggcggctagcgtggaccggcttgggcaggagctgatgccggcgccgtcgtcatccgcggacggcgcgtcgtcgaccactacgtccacccacgcgccgtccgaacacgacgaggaggaggaggagggagacatcaggctcgcaggcgagctgcggcggcttggctacgacgactag

SEQ ID NO: 260 - DNA, 1086 bp, Zea mays
atgggatgcttccattccacagccaagcggcagcatcctggctacgaggaccccgtgcacctcgcctcccagacctcctttagtgttagtgaggttgaggctctattcaagttgttcaagagcataagtggttcagtgattgacgatggcctgatcaacaaggacaatccttcggagaaggatattaaccaggggatgcttgttatatttaatgttgacccctctataacaaacaatgatatccatcagatatttagcgaatatggtgacataaaagagattcatgatgcaccgcaaaagggccatcacaaaattatagaattttatgatgtcagagcagccgaaggtgcagctcgtgctttaaacaggagtgatcttgcttgcaagaaaataaaactggagactggtcgtctgagtggtgctagacgttcaacacagcacatgtccaaggagttggggcaggaagaatttggcgtatacaacctgggcagtccaagcacaaatagcccttcattgccttcattgggtatggtgtttatttttttcatctttattgtatgtcatgtactcatgtctatggatgcatttcctgacgtgaggattattcttcaaggttcatctaatatagtagcaatgacatcttgtggacgtgaaaatgggagtatgcatggtttgcattctggacttctcacatcaatgagcccgttcagagaggcttcatttctgggtctatcatctaccctaccacagagcctgtcctctcccattggaattgcttctgctgcaactcatagtaaccaggctccccttggtgagctcagccactctcttagtcggatgaataggcatgtgaattatggttttcaaggcttgggtgctattcatccccattctcttcctgatgttcacaatggagcaaataatggcaccccttacaatctgaacaccatcacacctgttggtgtcaataagaactcaagaacagttgaagcagttgacagcagacatcttcataaagtgggttctggcaatctcaatgggcgctcatttgatcgtgccggtgaaggagttgtaaagtggtggtga

SEQ ID NO: 261 - DNA, 2880 bp, Zea mays
atgccatttcaagtcatggatccgaggcaccacctctcccagttcaccaatacaaccgtagctgcgtcctccttctctgaggagcagcttcgccttcccacagagaggctggtgggtttttggaagcaggagtcgttgcatcacattgggagcaagtcagttgcatcttctccaattgaaaagccccaacccattggtacaaaaacaatgggtcgggtagatccacaaccatacaagccgagaggccagaagtctgcatttagccttgaacacaaaacttttggtcaagagaggcatgttaacatgccaccatctctgtggagagctgatcaagacccttatgttcaatctgattcatctttatttcccgatggaaggagtactaatccatatgaggcctacaacgagaatgggcttttctcaagctccctgtcagaaatttttgacagaaaattgggactgagatcaaatgatgtgcttctacatcaaccacttgaaaaggttgaaccaactcatgtagatgatgagccctttgagttaacagaggaaatcgaggctcaaataataggaaacatacttcctgatgatgatgatctactatcaggtgttgatgttgggtacacagcccatgctagcaatggtgatgatgttgatgatgatatattttacactggaggtgggatggaactggagaccgttgaaaataaaaaaagtacagaacctaacagtggagctaatgatggtcttgggtcgctaaatggcacaatgaatggtcaacatccatatggggaacacccttcaagaactcttttcgtccagaacattaatagcaatgttgaggattctgaattaaaggtcctatttgagcattatggagaaatcagcaacctttacactgcctgcaaacatcgcggttttgtaatgatatcttactatgacataaggtcatcatggaatgccatgagggcacttcaaaacaagccactaagacatagaaaacttgacatacattactccattccgaaggataatccttcggggaaggatattaaccaggggatgcttgttgtatttaatgttgacccgtctgtaacaaacaatgatatccataagatatttagtgactatggtgaaataaaagagattcgtgatgcaccgcaaaagggccatcacaaagttatagaattttacgatgtcagagcagctgaaggtgcagttcgtgctttaaacaggagtgatcttgctggcaagaaaataaatttggggactgttggtctgagtggtgttagacgattaacacagcacatgtccaaagagtcggggcaagaagaatttggtgtatgcaaactgggcagtctaagcacaaatagccctccattgccttcattgggttcatcttatatggtagccatgacatcttctggccgtgaaaatgggagtattcatggtttgcattctggactgctcacatcaatgagcccgttcagagaggcttcttttccgggcctatcatctaccataccacagagcctgtcctctcccattggaattgcatctgctacaactcatagtaatcaggctccccttggtgagctcagccactcacttagtcggatgaatgggcatatgaattatggttttcaaggcttgggtgctcttcatccccattctcttcctgaagttcacgatggagcaaataatggcaccccgtacaatctaaacaccatggtaccaattggtgtgaatagcaactcaagaacagccgaagcagttgactgcagacatcttcataaagtgggttctagcaacctcaatggacattcatttgatcgtgtcggtgaaggagctatgggattttcaagaagtggaagtggtcctgtccatggtcaccagctaatgtggaataattcaaataacttacaacgtcatcccaattcccctgtgctgtggcaaaatccaggatcatttgtaaataatgtaccgtctcgctccccagcacaaatgcatggagttccaagagcaccatcacacatgattgagaatgtccttccaatgcatcatcatcatgtgggctctgcgccagcaatcaatccatcactttgggacaggcggcatggctatgcaggggaattgacagaagcatcaagttttcatcttggcagtgttgggagcttgggatttcctggtagccctcagcttcatggcctggagctaaataacatattttctcacactggtgggaatcgcatggatccaaccgtgtcttcggctcagatcagcgcaccatctcctcaacagagaggtcctatgttccatggaaggaatcctatggttccccttccatcatttgattcacctggtgagcggataagaagcatgagaaatgactcaggtgctaaccagtctgataataaacggcagtacgagcttgatgttgaccgcataatgcgaggggtagactcacgaactacactgatgataaagaatatcccaaataagtatacctccaagatgctcttggctgctattgatgaaagtcataagggcacttatgactttatttacttgccaattgattttaagaataaatgtaatgttggctatgctttcatcaacatgaccaatgctcagcatatcattccattttatcagacttttaatggtaaaaagtgggagaagtttaacagtgagaaggtggcatcacttgcttatgctagaatccaagggaaaacagctctgattgctcatttccagaactctagtttgatgaatgaggacaaacgttgccgccccatactcttccactcagatggtcctaatgcaggagatcagtgcactgtgacgagtcttctatataatccatataccttgaatccttga

SEQ ID NO: 262 - DNA, 2988 bp, Zea mays
atgccatctcaagtcatggatccgaggcgccacctctcccagttcagcaatccaaccgtggctgcgtcctccttctctgaggagcagtttcgccttcccacagagaggcaggtcggattttggaagcaggagtcgctgcatcacattggaagcaagtcagttgcatcttctccaattgaaaagccccaacccattgggacaaaaactgtgggtcgggtagaaccacaaccatacaagctgagagaccagaagactgcatttagccttgagcacaagacttttggtcaagagagacatgttaacctaccaccatctctgtggagagctgatcaagaccctaacctccaatctgatccatctttatttcccgatggaaggaggactagtccaaatgaggcctacaacgagaatgggcttttctcaagctccctatcagaaatttttgacagaaaattgggactgagatccatggatgtgcgtctacgccagccagttcaaaaggttgatctaactcatgtagatgatgagccctttgagttaacagaggaaatcgaggcgcaaataataggaaacatacttcctgatgatgatgacctactatcagatgttcttgatgttgggtacacagcccatgctaacatgggtgatgatgtcgatgatgatatattctacactggaggcgggatggaactggaaaccgatgaaaataaaaaaaatacagaacttaatggagctaatgatggtcttgggttgctaaatggcacaatgaatggtgaacatccatatggggaacacccttcaagaactctttttgtccgaaacattaatagcagcgttgaggattctgaattaaaactcctatttgaaaattatggagaaatcagcaacctttacactgcctgcaaacatcgtggttttgtgatgatatcttactatgacataagatcagcatggaatgccatgagggcacttcaaaacaagccactcagacgtagaaaacttgacatacattactccattccgaaggacaatccttcggagaaggatattaaccaggggatgcttgttgtatttaatgttgacccctctataacaaacaatgatatccatcagatatttagcgaatatggtgacataaaagagattcgcgatgcaccgcaaaagggccatcacaaaattatagaattttatgatgtcagagcagccgaaggtgcagctcgtgctttaaacaggagtgatcttgctggcaagaaaataaaactggagactggccgtctgagtggtgctagacgttcaacacagcacatgtccaaggagttggggcaggaagaatttggtgtatgcaaactgggcagtccaagcacaaatagcccttcattgccttcattgggttcatctaatatagcagcaatgacatcttgtggacgtgaaaatgggagtatgcatggtttgcattctggacttctcacatcaatgagcccgttcagagaggcttcatttctgggtctatcatctaccctaccacagagcctgtcctctcccattggaattgcttctgctgcaactcatagtaaccaggctccccttggtgagctcagccactctcttagtcggatgaatgggcatgtgaattatggttttcaaggcttgggtgctattcatccccattctcttcctgatgttcacaatggagcaaataatggcaccccttacaatctgaacaccatcacacctgttggtgtcaataagaactcaagaacagctgaagcagttgacagcagacatcttcataaagtgggttctggcaatctcaatgggcactcatttgatcgtgccggtgaaggagccatgggattttcaagaagtggaagcggtcataactgtggtcaccagttaatgtggaataattcaaataacttccacggtcatcccaattctcctgtgctgtggcaaaatcccggatcatttgtaaataatgtaccgtctcgccccccagcacaaatgcatggagttccaagagcaccatcacacatgattgagaatgttcttccaatgcatcatcatcatgtgggctctgcgccagcaatcaatccgtcactttgggacaggcggcatggctatgcaggggacttgacagaagcatcaagttttcatcctggcagtgttgggagcatgggatttcctggtagccctcagcttcatggtctggagctaaatagcatattttctcacactggtgggagtcgcatggatccaactgtgtcttcagctcagatcagcgcaccatctcaacagagaggtcctatgttccatggaaggaatcctatggtcccccttccttcatttgattcacctggtgagcggatgagaagccggagaaatgattcaggtgttaaccagtctgataataagcggcagtatgagcttgatgttgaccgcataatgcggggggaagactcacgaactacactgatgataaagaatatcccaaataagtatacctccaagatgctcttggctgctattgatgaaagtcataagggcacttatgattttatttacttgccaattgattttaagaataaatgtaatgtcggctatgctttcatcaacatgaccaatcctcagcatatcattccgttttatcagagttttaatggtaaaaagtgggagaagtttaacagtgagaaggtggcatcacttgcttatgccagaatccaagggaaaacagccctgattgctcatttccagaactctagtttgatgaatgaggacaaacgctgccgccccatacttttccactcagatggtcctaatgcaggagatcaggaacctttccccatgggttcaaacatccgagccaggtctgggagatcccggacttcttcgggtgaagaaaatcaccatgacatccagacagtcttgaccaacggtgacacttcttccaatggagctgacaattcaggtcccaccaaggatactgagtag

SEQ ID NO: 263 - DNA, 2823 bp, Zea mays
atggtgatagcgtcgggagccgttgacaggggccacctgtccccgattgctcccctgtcagagtcgccgtcgtcctcatcattcttctcccaggatctcgtccccactgagaggcaagttggattctggaaatcgtcagagtcaatggtcgatcacaaagggagcaagcctattttcacttctccactcgataaggcccatcccataggctcaagtcctgcaggtggtctggaacatcaacgaggtcaagccttcaaggggaagctgggcatgcttaaccttggtaatttggtggaccaacaagaaaatgctcctggcataccttcgatttcttggggtgatgtcctcagtacctccaggtccagtcttggcttgtctacaggagggacggcttttgttgaaccacccagtgctgatcaacatgtgcaagactatggagactgcttttcatccagctccttcactgaagtcttcggtagaaaatcagcaagattgatggcaagtggcgtttatggccaatcagctggtgcaaatgattccggttatgacggagatgaacctctagggtccatgaaagaaatggaagctcaaactattggtgatctccttcctgatgacgatgacctgatgtcgggaattattgatggctttgaatacaccggcttgtctaaccaggatgatgccgatgaagatatattctacactggaggaggtttggagctagagcatgatgattccaacaacgtcgacaaatttcgtgatgtgtccttcaagattcaactttctgagaagcactctatcgataaacaccattccagagctcttattgtaaaaaatattaatccaggcatcgagggttctgatttaagggctctgtttcagcaatatggggacgtacagacattcgacacatcctgcaagagccatggaattgttacagtgtcttactatgacattagagctgcacaggacgcagtgagagcagtccataacaaacctctggggctgatgaaacttgatgttcaattttcccttcctaaggaaaatgttccaaacaaagatcccaacaatggaacactggtggtatctcttattgactcttccatctccagccatgatcttctccaaaaatttagtgtttatggcgatgtcaaggagatttacaagtctcctacaagctgcaataagaaatttgtagaattctatgatatcagagcagcacaagaagcactgaatgacctcaacaagggtgaaatatcatgctcacaaatcaaagttgagcatagcttttctggaggagcaggatcttgcttcgcagagcaatattcaggagaacagaagcaaaatgccgtagctcaccaacttaagaactctccacctgggaccattgggaagttagatactaagagttgggacagcagcactgttcataatttatattctccagttagaccgcaacacgataaatcacaacatggcttctctgtgaatcctcctcagaagttgtcatcgcctatcagaattgaatctacacagcagcatagtaatcaaactgcttttggtgaacatagtggatctcttggtcatggcaactttggaggtgggctgcaagccttccacccgcactcactgccagagtgtcacaatggtatttgcaatggctataactccatgacattaaatgcaaggaattctaacttcagatttactgaaggaatagactacaataatcacaaagttgaccacagtgaccttcatggtcattcctctgatcaaaatgaagcaattagagttgctggaattggaagttgcccccttcatggacatcactatacctggagtaactcaaatggttttcctcaaagcccctctgctccaatgatgtggcctaactttcagcaaccagtgcatatgcattgctaccctgctatgcctcctcacatccggcgcagtgctgcccatcctatggaccaacatcacttgggttcagctccaaacagtgttggtggttttgcaaatgcacactcttttcatccaggatcccttgaaagcgtagggtttcctggcagccctcagctgtatccatcagatctctctgtatttgcatctgccagaggaaattacagggagaccatgttctctgccataagtgccgggtttccatcaattcagcaaattcttcatgcgaccaacggaaggaatcctatgatgcacgtctccacctcatatgacgccactaatgatcgcataaggagccgcaggcatgatggaaatgctgcccagtctgaaaacaagaagcagtttgagctggaccttgaccgcatagctaagggtgaagactcgcgcaccacactgatgataaaaaacattcctaacaagtacaccagtaagctgcttttggctgtcattgatgagaatcaccgaggaacttatgatttcatctaccttccaattgattttaagaataaatgtaacgtgggatatgcattcatcaatatgacggatccacagcagatagttccattttacaagacattcaacggcaagaaatgggagaagttcaatagtgagaaagtggcatcacttgcgtacgccagaatccagggaaggaacgctttgattgctcatttccagaattctagcctgatgaatgaagagaaatggtgccgccctatgcttttccacaaagatggcccgaacgcaggagaccaggaaccattccctgtgggtaacaatgttcgttctcggtccgggaggaacagaccacttagcagtggttcggagactaccaaagaggcaagtccatcaacctctcctaactga

SEQ ID NO: 264 - DNA, 945 bp, Zea mays
atgctccaaagattgctccaattggcaaggatagcaatcggtctaaatatgatcaagtcttctcaaatggtaaccagtcactggggagctgcatttcagcactcccactcatatcaagatcacaacagtgaacagatgagttctagtcctgggactttatcagggccccagtttctctggggaagtccaaagccatattcagaacattcaaaatcccctatttggcgtccaccagcaaacggacctgcattgtcatccagtagtcgcactcagggccaaggattcttgtacagtagccgtcaggcttcattatttggttctttagatcagcaccatcatcatgttggctctgccccttcaggtgctccattcgagaaccattttggctttttatcagaatcgccagagacatcttatatgaagcaactcaagtttgggaacatgggtaatgttggtattggtagaaacgggggaggcctcatgctgggcatggctagtcatgcttctgtgaatcctggttcttctctgattggaagtctgacagataacgtatcttctagcttcagaccgatattgtcaccgagattgggacaggcattttacactaatcctccataccatgggcctggtacattcggacttgacagctccattgaccatgcccgtaaccgcagagttgacagcagtgtgttgcaagctgatagcaagaggcagtatctgcttgacttggagaagattcgcagaggtgatgatactcggacaacattgatgattaagaacatcccgaacaaatatacatctaagatgctcctggctgcaattgatgagcttcacaaaggaatttatgacttcttctacctgccaattgatttcaagaacaaatgcaatgttggatatgcgttcattaacatggtatcaccggtgcacattatatccttctaccag

SEQ ID NO: 265 - DNA, 2472 bp, Zea mays
atggccgcaaataacaacccttggagggtccctatgccaccgctgctcaatgttcgagctggttttggcgatacaagtctcttctcaacctcactgcctgttcttcctcatgaaaagttgatcttttctcattcttctcatggtaccccatcaaaggatgacgcttcggccaaaatgaaagtgcttgctgatgatcctgatgagaaagactacaagttcgattttgatcttcgacagatagatgacttgttgcctgatgaagatgagtttttcgcggggatcactgatgaaactgagcccatcgggcaaacaaataccacagaggaattggaggagtttgatgtctttggcaatggagggggcatggagctggatattgaccctgtggagaccatcacagttagttttgcaaattcaagtattgtggacggggctagaggcaatggcatcaacccttttggtgtcccaaacactgtaggaactgtggctggggagcacccatttggagagcacccttccaggaccttgttcgtaaggaacatcaatagcaacgtcgaggactctgaactgcgatctttgtttgagcaatatggggatatccgtaccctttacactgcaacaaagcataggggctttgtaatgatatcttatttcgacatcagagctgcacggaatgcaatgcgcgcattgcagaacaaacctctgaggaggagaaagctggacattcatttttccatcccaaaggagaatccatctgacaaagatttaaaccagggaactcttgttatttttaacttggatccatcggtttctaatgaagaggttcgccagatttttggggcatatggggaagtaaaggagataagagagacaccaaacaagaaacatcataagtttatagagttctatgatgtaagagcagcagaggctgctcttcggtcactgaataaaagtgagatagctggaaaacgaatcaagttggaaccaagtcgtcctggtggaacacgcagaaacttgatgcagcagctcggtcacgatttggaccaagaggagcccagaagctacagacatcctcatgttggttcacctattgctaactctcctccaggggcatgggctcactatagtagtccaacagataacaatatgctgcaagctttcactaggtctccaactggaaatggaatgagtcctatcggaatgccttcactgatctcaaatgctccaaagattgctccaattggcaaggatagcaatcggtctaaatatgatcaagtcttctcaaatggtaaccagtcactgggagctgcatttcagcactcccactcatatcaagatcacaacagtgaacagatgagttctagtcctgggactttatcagggccccagtttctctggggaagtccaaagccatattcagaacattcaaaatcccctatttggcgtccaccagcaaacggacctgcattgtcatccagtagtcgcactcagggccaaggattcttgtacagtagccgtcaggcttcattatttggttctttagatcagcaccatcatcatgttggctctgccccttcaggtgctccattcgagaaccattttggctttttatcagaatcgccagagacatcttatatgaagcaactcaagtttgggaacatgggtaatgttggtattggtagaaacgggggaggcctcatgctgggcatggctagtcatgcttctgtgaatcctggttcttctctgattggaagtctgacagataacgtatcttctagcttcagaccgatattgtcaccgagattgggacaggcattttacactaatcctccataccatgggcctggtacattcggacttgacagctccattgaccatgcccgtaaccgcagagttgacagcagtgtgttgcaagctgatagcaagaggcagtatctgcttgacttggagaagattcgcagaggtgatgatactcggacaacattgatgattaagaacatcccgaacaaatatacatctaagatgctcctggctgcaattgatgagcttcacaaaggaatttatgacttcttctacctgccaattgatttcaagaacaaatgcaatgttggatatgcgttcattaacatggtatcaccggtgcacattatatccttctaccaggcttttaatggtaagaaatgggagaagttcaacagtgagaaggtagcatctttggcttatgctagaattcaaggacggtctgcactgatatcacattttcaaaattcaagtttgatgaatgaggataagaggtgccgccccattctttttaatcccaatggtcaggactctgtgaatcaggaagcattcccaattaatggtatatgcatccacatgcccctggaagatgattgccttgacaatgaagaaaacaagagtctgaacgagaagacaggagagaactctactgatatcgctgggagtttgtga

SEQ ID NO: 266 - DNA, 2544 bp, Zea mays
atggatcgatcgtcagattcttccaatccaccaggtcttgccgtgcctgccgcctcaaagccaccacagatggccgcaaataacaacccttggagggcccctctgccaccgctgctcaatgctcgcgctggttttggtggcgatacaagcctcttctcaacctcgctgccggttcttcctcatgaaaagttgatctttgctgattcttctcatggtaccccaccaatggatgacactttgaccaaaatgaaagtcctggctaatgatcctgatgagaaggactacaaatttgattttgatcttcggcagatagatgacttgttgccagatgaagatgagtttttcgcggggatcactgatgagactgagcccgttgcgcagacaaataccacggaggaattggaggagtttgatgtgtttggcaatggagggggcatggagctggacattgaccctgtggagagcatcacagttggttttgcaaattcaagtattgtcgacggggctagatgcaatagcatcaacccttttggtgtcccaagcactgtaggaactgtggctggggagcacccgtttggagagcacccttcgaggaccttgtttgtaaggaacatcaatagcaatgtcgaggactctgaactgcgatctttgtttgagcaatatggggacatccggaccctttacactgcaacaaagcacaggggctttgtaatgatatcttattttgatatcagagctgcacggaatgcaatgcgcgcattgcagaacaaacctctgaggaggagaaagctggacattcatttttccatcccaaaggagaatccatctgacaaagatttgaaccagggaactcttgttatttttaacttggatccgtcggtttctaatgaagaggttcgccagatttttggggcatatggtgaagtaaaggagataagagagacaccaaacaagaaacaccataagtttattgagttctatgatgtaagagcagcagaggctgctcttcggtcactgaataaaagtgagatagctggaaaacgaatcaagttggaaccaagtcgtcctggtggaacacgcagaaacttgatgcagcaacttggtcacgatttggaccaagaagagccaagaacctacagacattctcatgttggttcacctattgctaactctcctccaggggcatgggctcagtacagtagtccaacagatagcaatatgctgcaagctttcaccagatctccaactggaaatggaatgagtcctatcggaattccttccctgatttcaaatgctccaaagattgctcctattggcaaggatagcaaccggtctaagtatgatcaagtgttttcaaatggtaaccagtccgtgggagctgcatttcagcactcccactcataccaagatcacaacagtgaacacatgagttctagtcctgggactttatcagggccccagtttctctggggcagtccaaagccatattcagaacattcaaaatcccctatttggcatccaccaggaatcggatctgcattgtcatccagcagtcgcactcagggccaaggattcttgtacagtagccgtcaggcttcattatttggttcttcggatcagcaccatcatcatgttggctctgccccttcaggtgctccatttgagagccattttggcttcttacctgaatcgccagagacatcttttatgaagcaagccaggtttgggaacatgggtaattttggtactggccgaaacgggggaggtctcctgctgggcatggctaatcgtgcttctgtgaatcctggttcttctctaattggaagtctgacagataacagctctactaacttcagaccgatgttgtcgcctagattgggacagacattttacactaatcctccataccatgggattggtacattcggacttgacagctccattgaccgtgtccgcaaccgccgggttgacagcagtgtgttgcaggctgatagcaagaggcagtatcagcttgacttggagaagattcacagaggtgatgatactcggacaacattgatgattaagaacatcccaaacaagtatacatctaagatgctcctggctgcaattgatgagcttcacagaggaacttatgactttttctacctgccaattgatttcaagaacaaatgcaatgttggatacgcgttcgttaacatgatatcgccggtgcatattatatccttctaccaggcttttaatggtaagaaatgggaaaagttcaacagcgagaaggtagcctcgttggcttatgctagaattcaaggacggtctgcactgatatcacattttcaaaattcaagtttgatgaatgaggataagaggtgccgccccattctttttaatcccaatggtcaggagtctgtgcaccaggaagcatttccaatcaatggcatatgcatccacatgcttccggaagatgattaccttgacaatgaagatggcaagagtctgaacgagaagactggagagagctcgaccgatatggccgggagtttgtga

SEQ ID NO: 267 - DNA, 2859 bp, Zea mays
atggccccggttttgttcgggacccaaatttccgcgcacttcgtcaaggtttctgtgtttatggctttatgctttgaatttctgatccgtttgaaccgagctcacgggagcgttgaaacttgtctctgtgttttaaggtccggggtgaggcgcagcgcccgcaggatgccaaccgagcagaggcgctacatgcccccggcccattttcttccggcggagtcggaatcgtcctccttccctgacgagcttcgcttgcgtcctgagaggcaagttggacttttgaagcagggttgctttcctgagcatgctggcagatttgcttgttctcccctgcaaaagctcaagtgtattggcgcaacagtagtggatcagctagatattatgcagccacacaagctaatggaccagaaagtgccatttagccttgatgacaagttgttggatgttaagctgccaccatcttcctggagagaggatcaggatccagcaaaccaactcgattcttttcccaagccattggtttcacctctagaaggtagaaggggaagtgtaaatgggacccaatatgaaagtggacttttctctagctcccttccagaattttttgacaagaaaagtggaatggaattggaagcagatggaaatagcaaattgttaaactttaatggtggagccagtcagactaggtcaattgtccaactcaatggtgagcgatcctcgagaatcctttttgtcggaaacattgatagcaacgtcgaggattctgaattgaaattcatgtttgagcaatatggagacatgcagacacttaatgcttcttgcaaacatcatggttttgtgatggtatcttactatgatataagatcggcagaaaatgctatgagggcccttcaaagcaagccactcagatgtaggaaacttgacatacgttactcgagtccaaaggactatcctttggataaagatatcaacctgtccatggtaatagttaatcttgaagcttcgataactaatgatgacctgcaccagatatttggtgtctttggtgaaatcaaggagattcaccctacttcagataatgaccattacaaatcgatagaattttttgatgtcagagcagctgaagctgcacaatatgccttaaacaggagtgaaatttcaggaaataaaaacaaattggagcctagctgtctgggtggtactgaacgtttgatgcagcagatgtctcgtgcattggaacatgaacagtttggtgcatgtaaactcggaagcccaaacagtccttcaacatgctttggttctgtcaatatggcacccatcagatccactagcacagaaagtggaactgttcaggttttatgttctagagttcagacaccgataaaccaattccgagagggaaggaattttctggatcttccctcaactaccataagtagatcctctcctgttggaattacacctgcaggattacaaagcggccaccacgctcttgatgagcacatccattcacttggaaagatgaatgtacagaacaagggacgaatggattgtggatttcaagagagtactgctttccatcctcattctctccctgacttcaatgacagactaagaaatgcaatggatgtcaggcacatttacaaaggaggttgtgggcatctcagcaatcaatcttctgctcatactgaagcacttgggttttcaagaactggtagctgccctctctatggtcaccaactagcatggagtaattctaataacctacaccagcagccttcttctcccatgatatggcctagcatgggcccatttaccaataatatgccatctcgccagttgatgcaagtgcatggaatttcaagagcaccattgcgcatgcttgaaaataatatccctatgaatcaccaacatgtgggatctgccccagctgtcaatccatcaatttgggatagacgacatggatatgcaggggagatgatggaaacaccaggattccacccagggagtgctggaagcatgggtttccctggcagcacacatctgcatcagttggagaccaatggtatgtttcctcacaatggagggactttcatggacccagctatgtctcctgtgcacatgagtgctcgctctcctcagcagagggggcatattttccatcgaaggagcaatgtggctcctattccatcctctttcgattctgctggtgaacggatgcggagccgaagaaatgactcgaatgtaaatcaatctgacaacaaaaggctgtttgagcttgacattgagcgtatagtccggggcgaggactcccggactacactgatgataaagaatatcccaaacaagtacacatcaaagatgcttctggcagctattgatgaaagtcaccggggaacttatgattttatctacctgccaattgactttaagaataagtgcaatgttggttatgcattcatcaacatgatcaatcctgacaatattgttccattttataagacatttcatgggaaaaggtgggagaaattcaacagtgagaaagtggcctcacttgcttatgctagaatccaaggaaaatcagctctagttgctcatttccagaactcaagtttgatgaatgaggataaacgctgccgccctatactcttccactctgatggtccgaatgcaggagatcaagaaccattccctgtgggatcaaatgtccgttccaggcctggaaggtccaggattttgagttgggaacaaaaccaccaggacattgtgtctgatcataccaaaggtggaactccgagcagggctggtggcactccaggttacatcgccacggatactgatcatacggctgttgattga

SEQ ID NO: 268 - protein, 326 aa, Zea mays
MGCFHSTAKRQHPGYEDPVHLASQTSFSVSEVEALFELFKSISRSVIDDGLINMVYSITHLCIPCYIVSFVYEHQNKPLRRRKLDIHYSIPKDNPSEKDINQGMLVIFNVDPSITNNDIHQIFSEYGDIKEIHDAPQKGHHKIIEFYNVRAAEGAARALNRSDLAGKKIKLETGRLSGARRSTQHMSKELGLEEFGVYNLGSPSTNSPSLPSLGMSLSSPIGIASAATHSNQAPLGEISHSLSRMNRHVNYGFQGLGAIHPHSLPDVHNGANNGTPYNLNTITPVGVNKNSRTAEAVDSRHLHKVGSGNLNGHSFDRAGEGVVKWW

SEQ ID NO: 269 - protein, 345 aa, Zea mays
MGCFHSTAKRQHPGYEDPVHLASQTSFSVSEVEALFELFKSISGSVIDDGLINKVNSISHLCIPCYIVSFVYEHQNKPLRRRKLDIHYSIPKDNPSEKDINQGMLAIFNVDPSITNNDIHQIFSEYGDIKEIHDAPQKGHHKIIEFYDVRAAEGAARALNRSDLAGKKIKLETGHLSGARRSTQHMSKELGQEEFGIYNLGSPSTNSPSLPSLGSSNIVAMTSCGRENGSMHGLHSGLLTSMSPFREASFLGLSSTLPQSLSSPIGIASAATHSLGAIHPHSLPDVHNGANNGTPYNLNTITPVGVNKNSRTAEAVDNRHLHKVGSGNLNGHSFDRAGEGVVKWW

SEQ ID NO: 270 - protein, 664 aa, Zea mays
MEGGGGSGMGGFPEATGNLLDAAAQEFHPTVCAPYPLQPLPQQLYCPHPYPAMPVPPPPQIAMLQPVPPMAMAMAPQPGYTLPTTTPVVNGPSSRVVVLGLVPPHAQEADVAQAMAPFGAIRSVDACAVASEGVATVHFFDIRAAELALTCVREQHMRQQSRLGQLYAAAAVAPAWAPAPTPQAWDWPHPNDDGRGLVLGHAVWAHFATGADDGDNRGSLVVLSPLPGVSVADLRQVFQAFGDLKDVRESAQRPSHKFVDFFDTRDAARALAELNGQELFGRRLVVEFTRPSGPGPRRRGYAPHQHRPTAPTPPRLQATWRPSQPTSSQPPASSSSSGSVRAREGVVLLRRSSCKSSAGSDQSSKGGNAGTSHERKTKGGKIVVAAAAASSSTPTASGKQTQKGVGSSGGGSWKGRKSGWEARFLFKEPEAGGGADTQATPASEMDTRTTVMIRNIPNKYSQKLLLNMLDNHCIQSNEWIVASGEEQPFSAYDFVYLPIDFNNKCNVGYGFVNLTSPEAAVRLYKAFHKQPWEVYNSRKICQVTYARVQGLEALKEHFKNSKFPCDSDEYLPVAFSPARDGKELTDPVPIVGRSPAASSASSPPKSRAASVDRLGQELMPAPSSSADGASSTTTSTHAPSEHDEEEEEGDIRLAGELRRLGYDD

SEQ ID NO: 271 - protein, 361 aa, Zea mays
MGCFHSTAKRQHPGYEDPVHLASQTSFSVSEVEALFKLFKSISGSVIDDGLINKDNPSEKDINQGMLVIFNVDPSITNNDIHQIFSEYGDIKEIHDAPQKGHHKIIEFYDVRAAEGAARALNRSDLACKKIKLETGRLSGARRSTQHMSKELGQEEFGVYNLGSPSTNSPSLPSLGMVFIFFIFIVCHVLMSMDAFPDVRIILQGSSNIVAMTSCGRENGSMHGLHSGLLTSMSPFREASFLGLSSTLPQSLSSPIGIASAATHSNQAPLGELSHSLSRMNRHVNYGFQGLGAIHPHSLPDVHNGANNGTPYNLNTITPVGVNKNSRTVEAVDSRHLHKVGSGNLNGRSFDRAGEGVVKWW

SEQ ID NO: 272 - protein, 959 aa, Zea mays
MPFQVMDPRHHLSQFTNTTVAASSFSEEQLRLPTERLVGFWKQESLHHIGSKSVASSPIEKPQPIGTKTMGRVDPQPYKPRGQKSAFSLEHKTFGQERHVNMPPSLWRADQDPYVQSDSSLFPDGRSTNPYEAYNENGLFSSSLSEIFDRKLGLRSNDVLLHQPLEKVEPTHVDDEPFELTEEIEAQIIGNILPDDDDLLSGVDVGYTAHASNGDDVDDDIFYTGGGMELETVENKKSTEPNSGANDGLGSLNGTMNGQHPYGEHPSRTLFVQNINSNVEDSELKVLFEHYGEISNLYTACKHRGFVMISYYDIRSSWNAMRALQNKPLRHRKLDIHYSIPKDNPSGKDINQGMLVVFNVDPSVTNNDIHKIFSDYGEIKEIRDAPQKGHHKVIEFYDVRAAEGAVRALNRSDLAGKKINLGTVGLSGVRRLTQHMSKESGQEEFGVCKLGSLSTNSPPLPSLGSSYMVAMTSSGRENGSIHGLHSGLLTSMSPFREASFPGLSSTIPQSLSSPIGIASATTHSNQAPLGELSHSLSRMNGHMNYGFQGLGALHPHSLPEVHDGANNGTPYNLNTMVPIGVNSNSRTAEAVDCRHLHKVGSSNLNGHSFDRVGEGAMGFSRSGSGPVHGHQLMWNNSNNLQRHPNSPVLWQNPGSFVNNVPSRSPAQMHGVPRAPSHMIENVLPMHHHHVGSAPAINPSLWDRRHGYAGELTEASSFHLGSVGSLGFPGSPQLHGLELNNIFSHTGGNRMDPTVSSAQISAPSPQQRGPMFHGRNPMVPLPSFDSPGERIRSMRNDSGANQSDNKRQYELDVDRIMRGVDSRTTLMIKNIPNKYTSKMLLAAIDESHKGTYDFIYLPIDFKNKCNVGYAFINMTNAQHIIPFYQTFNGKKWEKFNSEKVASLAYARIQGKTALIAHFQNSSLMNEDKRCRPILFHSDGPNAGDQCTVTSLLYNPYTLNP

SEQ ID NO: 273 - protein, 995 aa, Zea mays
MPSQVMDPRRHLSQFSNPTVAASSFSEEQFRLPTERQVGFWKQESLHHIGSKSVASSPIEKPQPIGTKTVGRVEPQPYKLRDQKTAFSLEHKTFGQERHVNLPPSLWRADQDPNLQSDPSLFPDGRRTSPNEAYNENGLFSSSLSEIFDRKLGLRSMDVRLRQPVQKVDLTHVDDEPFELTEEIEAQIIGNILPDDDDLLSDVLDVGYTAHANMGDDVDDDIFYTGGGMELETDENKKNTELNGANDGLGLLNGTMNGEHPYGEHPSRTLFVRNINSSVEDSELKLLFENYGEISNLYTACKHRGFVMISYYDIRSAWNAMRALQNKPLRRRKLDIHYSIPKDNPSEKDINQGMLVVFNVDPSITNNDIHQIFSEYGDIKEIRDAPQKGHHKIIEFYDVRAAEGAARALNRSDLAGKKIKLETGRLSGARRSTQHMSKELGQEEFGVCKLGSPSTNSPSLPSLGSSNIAAMTSCGRENGSMHGLHSGLLTSMSPFREASFLGLSSTLPQSLSSPIGIASAATHSNQAPLGELSHSLSRMNGHVNYGFQGLGAIHPHSLPDVHNGANNGTPYNLNTITPVGVNKNSRTAEAVDSRHLHKVGSGNLNGHSFDRAGEGAMGFSRSGSGHNCGHQLMWNNSNNFHGHPNSPVLWQNPGSFVNNVPSRPPAQMHGVPRAPSHMIENVLPMHHHHVGSAPAINPSLWDRRHGYAGDLTEASSFHPGSVGSMGFPGSPQLHGLELNSIFSHTGGSRMDPTVSSAQISAPSQQRGPMFHGRNPMVPLPSFDSPGERMRSRRNDSGVNQSDNKRQYELDVDRIMRGEDSRTTLMIKNIPNKYTSKMLLAAIDESHKGTYDFIYLPIDFKNKCNVGYAFINMTNPQHIIPFYQSFNGKKWEKFNSEKVASLAYARIQGKTALIAHFQNSSLMNEDKRCRPILFHSDGPNAGDQEPFPMGSNIRARSGRSRTSSGEENHHDIQTVLTNGDTSSNGADNSGPTKDTE

SEQ ID NO: 274 - protein, 940 aa, Zea mays
MVIASGAVDRGHLSPIAPLSESPSSSSFFSQDLVPTERQVGFWKSSESMVDHKGSKPIFTSPLDKAHPIGSSPAGGLEHQRGQAFKGKLGMLNLGNLVDQQENAPGIPSISWGDVLSTSRSSLGLSTGGTAFVEPPSADQHVQDYGDCFSSSSFTEVFGRKSARLMASGVYGQSAGANDSGYDGDEPLGSMKEMEAQTIGDLLPDDDDLMSGIIDGFEYTGLSNQDDADEDIFYTGGGLELEHDDSNNVDKFRDVSFKIQLSEKHSIDKHHSRALIVKNINPGIEGSDLRALFQQYGDVQTFDTSCKSHGIVTVSYYDIRAAQDAVRAVHNKPLGLMKLDVQFSLPKENVPNKDPNNGTLVVSLIDSSISSHDLLQKFSVYGDVKEIYKSPTSCNKKFVEFYDIRAAQEALNDLNKGEISCSQIKVEHSFSGGAGSCFAEQYSGEQKQNAVAHQLKNSPPGTIGKLDTKSWDSSTVHNLYSPVRPQHDKSQHGFSVNPPQKLSSPIRIESTQQHSNQTAFGEHSGSLGHGNFGGGLQAFHPHSLPECHNGICNGYNSMTLNARNSNFRFTEGIDYNNHKVDHSDLHGHSSDQNEAIRVAGIGSCPLHGHHYTWSNSNGFPQSPSAPMMWPNFQQPVHMHCYPAMPPHIRRSAAHPMDQHHLGSAPNSVGGFANAHSFHPGSLESVGFPGSPQLYPSDLSVFASARGNYRETMFSAISAGFPSIQQILHATNGRNPMMHVSTSYDATNDRIRSRRHDGNAAQSENKKQFELDLDRIAKGEDSRTTLMIKNIPNKYTSKLLLAVIDENHRGTYDFIYLPIDFKNKCNVGYAFINMTDPQQIVPFYKTFNGKKWEKFNSEKVASLAYARIQGRNALIAHFQNSSLMNEEKWCRPMLFHKDGPNAGDQEPFPVGNNVRSRSGRNRPLSSGSETTKEASPSTSPN

SEQ ID NO: 275 - protein, 315 aa, Zea mays
MLQRLLQLARIAIGLNMIKSSQMVTSHWGAAFQHSHSYQDHNSEQMSSSPGTLSGPQFLWGSPKPYSEHSKSPIWRPPANGPALSSSSRTQGQGFLYSSRQASLFGSLDQHHHHVGSAPSGAPFENHFGFLSESPETSYMKQLKFGNMGNVGIGRNGGGLMLGMASHASVNPGSSLIGSLTDNVSSSFRPILSPRLGQAFYTNPPYHGPGTFGLDSSIDHARNRRVDSSVLQADSKRQYLLDLEKIRRGDDTRTTLMIKNIPNKYTSKMLLAAIDELHKGIYDFFYLPIDFKNKCNVGYAFINMVSPVHIISFYQ

SEQ ID NO: 276 - protein, 823 aa, Zea mays
MAANNNPWRVPMPPLLNVRAGFGDTSLFSTSLPVLPHEKLIFSHSSHGTPSKDDASAKMKVLADDPDEKDYKFDFDLRQIDDLLPDEDEFFAGITDETEPIGQTNTTEELEEFDVFGNGGGMELDIDPVETITVSFANSSIVDGARGNGINPFGVPNTVGTVAGEHPFGEHPSRTLFVRNINSNVEDSELRSLFEQYGDIRTLYTATKHRGFVMISYFDIRAARNAMRALQNKPLRRRKLDIHFSIPKENPSDKDLNQGTLVIFNLDPSVSNEEVRQIFGAYGEVKEIRETPNKKHHKFIEFYDVRAAEAALRSLNKSEIAGKRIKLEPSRPGGTRRNLMQQLGHDLDQEEPRSYRHPHVGSPIANSPPGAWAHYSSPTDNNMLQAFTRSPTGNGMSPIGMPSLISNAPKIAPIGKDSNRSKYDQVFSNGNQSLGAAFQHSHSYQDHNSEQMSSSPGTLSGPQFLWGSPKPYSEHSKSPIWRPPANGPALSSSSRTQGQGFLYSSRQASLFGSLDQHHHHVGSAPSGAPFENHFGFLSESPETSYMKQLKFGNMGNVGIGRNGGGLMLGMASHASVNPGSSLIGSLTDNVSSSFRPILSPRLGQAFYTNPPYHGPGTFGLDSSIDHARNRRVDSSVLQADSKRQYLLDLEKIRRGDDTRTTLMIKNIPNKYTSKMLLAAIDELHKGIYDFFYLPIDFKNKCNVGYAFINMVSPVHIISFYQAFNGKKWEKFNSEKVASLAYARIQGRSALISHFQNSSLMNEDKRCRPILFNPNGQDSVNQEAFPINGICIHMPLEDDCLDNEENKSLNEKTGENSTDIAGSL

SEQ ID NO: 277 - protein, 847 aa, Zea mays
MDRSSDSSNPPGLAVPAASKPPQMAANNNPWRAPLPPLLNARAGFGGDTSLFSTSLPVLPHEKLIFADSSHGTPPMDDTLTKMKVLANDPDEKDYKFDFDLRQIDDLLPDEDEFFAGITDETEPVAQTNTTEELEEFDVFGNGGGMELDIDPVESITVGFANSSIVDGARCNSINPFGVPSTVGTVAGEHPFGEHPSRTLFVRNINSNVEDSELRSLFEQYGDIRTLYTATKHRGFVMISYFDIRAARNAMRALQNKPLRRRKLDIHFSIPKENPSDKDLNQGTLVIFNLDPSVSNEEVRQIFGAYGEVKEIRETPNKKHHKFIEFYDVRAAEAALRSLNKSEIAGKRIKLEPSRPGGTRRNLMQQLGHDLDQEEPRTYRHSHVGSPIANSPPGAWAQYSSPTDSNMLQAFTRSPTGNGMSPIGIPSLISNAPKIAPIGKDSNRSKYDQVFSNGNQSVGAAFQHSHSYQDHNSEHMSSSPGTLSGPQFLWGSPKPYSEHSKSPIWHPPGIGSALSSSSRTQGQGFLYSSRQASLFGSSDQHHHHVGSAPSGAPFESHFGFLPESPETSFMKQARFGNMGNFGTGRNGGGLLLGMANRASVNPGSSLIGSLTDNSSTNFRPMLSPRLGQTFYTNPPYHGIGTFGLDSSIDRVRNRRVDSSVLQADSKRQYQLDLEKIHRGDDTRTTLMIKNIPNKYTSKMLLAAIDELHRGTYDFFYLPIDFKNKCNVGYAFVNMISPVHIISFYQAFNGKKWEKFNSEKVASLAYARIQGRSALISHFQNSSLMNEDKRCRPILFNPNGQESVHQEAFPINGICIHMLPEDDYLDNEDGKSLNEKTGESSTDMAGSL

SEQ ID NO: 278 - protein, 952 aa, Zea mays
MAPVLFGTQISAHFVKVSVFMALCFEFLIRLNRAHGSVETCLCVLRSGVRRSARRMPTEQRRYMPPAHFLPAESESSSFPDELRLRPERQVGLLKQGCFPEHAGRFACSPLQKLKCIGATVVDQLDIMQPHKLMDQKVPFSLDDKLLDVKLPPSSWREDQDPANQLDSFPKPLVSPLEGRRGSVNGTQYESGLFSSSLPEFFDKKSGMELEADGNSKLLNFNGGASQTRSIVQLNGERSSRILFVGNIDSNVEDSELKFMFEQYGDMQTLNASCKHHGFVMVSYYDIRSAENAMRALQSKPLRCRKLDIRYSSPKDYPLDKDINLSMVIVNLEASITNDDLHQIFGVFGEIKEIHPTSDNDHYKSIEFFDVRAAEAAQYALNRSEISGNKNKLEPSCLGGTERLMQQMSRALEHEQFGACKLGSPNSPSTCFGSVNMAPIRSTSTESGTVQVLCSRVQTPINQFREGRNFLDLPSTTISRSSPVGITPAGLQSGHHALDEHIHSLGKMNVQNKGRMDCGFQESTAFHPHSLPDFNDRLRNAMDVRHIYKGGCGHLSNQSSAHTEALGFSRTGSCPLYGHQLAWSNSNNLHQQPSSPMIWPSMGPFTNNMPSRQLMQVHGISRAPLRMLENNIPMNHQHVGSAPAVNPSIWDRRHGYAGEMMETPGFHPGSAGSMGFPGSTHLHQLETNGMFPHNGGTFMDPAMSPVHMSARSPQQRGHIFHRRSNVAPIPSSFDSAGERMRSRRNDSNVNQSDNKRLFELDIERIVRGEDSRTTLMIKNIPNKYTSKMLLAAIDESHRGTYDFIYLPIDFKNKCNVGYAFINMINPDNIVPFYKTFHGKRWEKFNSEKVASLAYARIQGKSALVAHFQNSSLMNEDKRCRPILFHSDGPNAGDQEPFPVGSNVRSRPGRSRILSWEQNHQDIVSDHTKGGTPSRAGGTPGYIATDTDHTAVD

SEQ ID NO: 279 - DNA, 2856 bp, Artificial Sequence
  dpzm10g029750
atggcgccagtgctctttggaactcagatctcagcacattttgtcaaggtttcggtctttatggctctttgtttcgagttcctgattaggctcaaccgcgcacatggttccgtggaaacgtgcctctgtgtgttgcgctctggcgtgagaagatcagccaggagaatgcctactgaacagagacggtacatgcccccagctcattttctgccggcggagtccgagagctcgagcttccctgatgagttgcggctgagaccggagaggcaggtcgggctcttgaaacaagggtgttttccagaacatgcggggcggttcgcttgttcgccccttcaaaaactgaagtgtattggggcaacagtggtcgatcaactcgatatcatgcaaccccacaagttgatggatcagaaagtcccttttagcctcgacgacaaattgttggacgttaaactgccgccctcaagctggagggaagatcaggacccagcgaaccaactggattcgttcccgaaaccgctcgtgtctcctctggagggacggcggggatctgttaacggcactcagtacgaatcgggcttgttttcttcctcgctgcctgagttctttgataaaaaatccggtatggagcttgaggcagatgggaacagcaaacttttgaattttaatggtggtgcctcgcagacgagatctatagtgcagcttaacggagagagatcgagccgcatcttgtttgtcggcaacattgactccaacgtcgaggactcagagctcaagttcatgtttgagcaatatggtgacatgcagacacttaacgcttcatgcaagcatcatggattcgtgatggtttcctattacgacataagatcagccgagaatgctatgcgggccctccagtccaagccattgcggtgtagaaaattggatatcaggtactctagcccgaaggactacccgttggacaaggatattaatctctctatggtcatagtgaacttggaagcttcaataaccaacgatgaccttcaccaaatttttggagtcttcggtgaaatcaaggagatacaccctacgtcggacaacgatcactataaatcgattgaattttttgatgttcgggcggcggaagccgcacagtacgcgttgaataggagcgagatctctggaaacaaaaacaagctggagcctagctgcttgggtggcaccgaaagattgatgcagcaaatgtccagggcactcgaacacgaacaattcggtgcatgtaagttggggtctccaaattctccttcaacgtgttttggttccgtgaacatggcccccatacgctcaacttccacagagtctggcacagttcaggttctgtgttcgagggtccagactcctataaatcagtttcgcgagggtcggaatttcttggacttgccgtctacgacgatttcacgctcctctccggttggcatcacacctgccggccttcaatctggtcatcacgctttggatgaacacatacactctctgggcaaaatgaacgtccaaaacaaagggagaatggattgcggtttccaggaatctacagcattccatccgcacagccttccagattttaatgaccgccttcggaatgccatggatgtcaggcatatctacaaaggtgggtgcgggcacttgagcaaccagtcatcagctcataccgaggcactcgggttttctcgcacagggccttgtccgctcccaggccatcagctcgcttggagcaattctaacaacttgcatcagcagccttccagcccaatgatttggccttccatgggtccctttaccaacaatatgccatcgaggcaactcatgcaggttcatggcatttctagggcacctctgagaatgcttgagaataacatacccatgaaccaccaacatgtcggttccgcgccggctgttaacccatctatatgggataggcgccacgggtacgccggagagatgatggaaacgccaggatttcaccctgggtccgccggctccatggggtttcctgggtccacacacttgcaccagctcgagactaatgggatgtttccgcacaacggtgggacctttatggatcctgcgatgtctccggtccacatgtcagcgcgctcgccccagcaaaggggtcacatctttcacagacggtctaacgtggcacccataccttcgtcctttgactccgccggtgaaaggatgcgctcgagaaggaatgacagcaatgttaatcaatcggataataagaggttgtttgagttggacattgaaagaattgtgagaggggaggacagcaggaccaccctcatgataaaaaacatccctaacaaatacacctcgaaaatgttgttggcggccatcgacgagtcgcacagggggacgtacgatttcatttaccttcccattgatttcaagaacaaatgcaacgtgggttacgcatttattaacatgattaacccggataacattgtcccgttttacaaaacctttcatgggaaacgctgggaaaagtttaattccgaaaaggtggccagcttggcgtatgcaaggattcaagggaagtcggctttggtggcccacttccaaaacagctctctgatgaacgaggataaaagatgtagaccaattctgttccactccgatgggcccaacgcgggagaccaagagccctttccagtcgggtcgaatgtgagatcacgcccaggacgcagccgcattctgagctgggagcagaatcaccaagatatagtgtcggatcacacaaaaggaggtactccaagcagggccggtgggacgcccggttatatagcaacggatacagatcataccgcggtggac

SEQ ID NO: 280 - protein, 952 aa, Artificial Sequence
  dpzm10g029750
MAPVLFGTQISAHFVKVSVFMALCFEFLIRLNRAHGSVETCLCVLRSGVRRSARRMPTEQRRYMPPAHFLPAESESSSFPDELRLRPERQVGLLKQGCFPEHAGRFACSPLQKLKCIGATVVDQLDIMQPHKLMDQKVPFSLDDKLLDVKLPPSSWREDQDPANQLDSFPKPLVSPLEGRRGSVNGTQYESGLFSSSLPEFFDKKSGMELEADGNSKLLNFNGGASQTRSIVQLNGERSSRILFVGNIDSNVEDSELKFMFEQYGDMQTLNASCKHHGFVMVSYYDIRSAENAMRALQSKPLRCRKLDIRYSSPKDYPLDKDINLSMVIVNLEASITNDDLHQIFGVFGEIKEIHPTSDNDHYKSIEFFDVRAAEAAQYALNRSEISGNKNKLEPSCLGGTERLMQQMSRALEHEQFGACKLGSPNSPSTCFGSVNMAPIRSTSTESGTVQVLCSRVQTPINQFREGRNFLDLPSTTISRSSPVGITPAGLQSGHHALDEHIHSLGKMNVQNKGRMDCGFQESTAFHPHSLPDFNDRLRNAMDVRHIYKGGCGHLSNQSSAHTEALGFSRTGPCPLPGHQLAWSNSNNLHQQPSSPMIWPSMGPFTNNMPSRQLMQVHGISRAPLRMLENNIPMNHQHVGSAPAVNPSIWDRRHGYAGEMMETPGFHPGSAGSMGFPGSTHLHQLETNGMFPHNGGTFMDPAMSPVHMSARSPQQRGHIFHRRSNVAPIPSSFDSAGERMRSRRNDSNVNQSDNKRLFELDIERIVRGEDSRTTLMIKNIPNKYTSKMLLAAIDESHRGTYDFIYLPIDFKNKCNVGYAFINMINPDNIVPFYKTFHGKRWEKFNSEKVASLAYARIQGKSALVAHFQNSSLMNEDKRCRPILFHSDGPNAGDQEPFPVGSNVRSRPGRSRILSWEQNHQDIVSDHTKGGTPSRAGGTPGYIATDTDHTAVD

SEQ ID NO: 281 - DNA, 1023 bp, Zea mays
atgtcctcgtcttcggcgcaccagaaggcgtcgccgccgatagaggaggaagcgacggagcacggacccttccccatcgaacagctacaggcatctggaatagctgcacttgatgtgaaaaaactcaaagatgctggtctctgcacagtggaatctgtagcatactctccaaggaaagaccttttgcaaattaaagggattagtgaagccaaagtcgacaagataattgaagcagcttccaagttggttccactcggatttactagtgctagccaacttcatgcacagagacttgagatcatccagcttacaactggatctagagagcttgatcaaattttggacggtggaatagaaacaggatctatcacagagatgtatggtgaatttcgctccgggaagactcagttgtgccacactctctgtgtcacatgtcagctcccattggaccaaggtggtggtgaaggaaaggctttgtatattgatgcagagggtacattcaggcctcaaagaattctccagatagcagacaggtttggcttgaatggcgctgatgtactagagaatgtggcttatgccagagcatataacactgatcatcaatcaagacttttgctagaagcagcctccatgatggtagagaccaggtttgctctcatggttgtggatagtgctacagccctttacagaactgatttctctggtagaggggagctatcagcaaggcagatgcatctggcgaagtttcttaggagccttcaaaagttagcagatgagtttggagtggcagtggtaatcacgaaccaagtagtggctcaagtggatggtgctgcaatgtttgctgggccacagatcaagcccattggagggaacatcatggctcatgcttccacaactaggctctttcttcgcaagggaagaggggaggagcggatctgcaaagtaatcagctctccctgcctggctgaagctgaagcaaggtttcagatatcatctgagggtgtcactgatgtcaaggactga

SEQ ID NO: 282 - DNA, 906 bp, Zea mays
atgactgggcgcccgccgctctacgccaggtctccggctcgtcgccaggccttcgcgagcaacgagcacccaccaccaggtaagcgcaccctccctccctcccttccggcgatgaccgggcggccgccgccctacgccaggtcttcggcccgtcgccaggccttcgcgggcgacgagcatccaccaccagctctgctgggtcctccgccgctggtcgacccgagcgcaggccgaggagtgtgcttgatgagcacctcatggagggacaagcagcgcccggaactcgtcaatttcgtcgccacgttcctcgctaccaacatgtaccgcctcaatttcatgtcgctttctccggacttcatattcaacaatgggggcttatcggttgctttcgccttcgagaccgactggcttcctgaaagggaagctgcggtcttcagcagggtgactacactgaagaggcagttcaagtacctctatgtcgttgtcgtcgtccgctcggcagagcagaatgaatcatttaatcagtcatatttcaagtatggcatggagcttggctgtccaacattcgtccctgtttgtgatccagcgatgggattcgagaagattgtaaggatagctcatgctcgtggagtctgcaagcagaaagacaatatcgcaactatgagaattgagcgtgagcaagctgttcagtgcatggatgcgtttttacgagtgctcacctctattcctggtattgacagtcatgatgcaaatgcccttgcccaagccattggctctatcgaagcaattgcaaaagcatccaaggaattcattttggaaaacaccgacctttccactgaaaaggcagagagaattgttaggttcttcagggatccacagtacttcttaagccctaaacttaattaa

SEQ ID NO: 283 - DNA, 1044 bp, Zea mays
atggcggacgccgccgacagcagcatggcgctggtgcattcaagcctggcagactccgtgctgacgtcgccgcggacgttgaggcaggggcagaagtgggaggtggagtatgcgcgctacttcggtacgccgcggcgggaccccaccgcggctccaccatcagggctccgctacatcatgcggggcgtccaccgccaccagggaacctggatccccgcctcatgccccgcttctctctgcgtctgccaccctagcctcccctccgcggtccccgtcctcaccatctccatcggcgacgtcgtcttcgaggagcactttgtgtcgattctcaacttctcttggcctcaggttacttgtgtgacgcagtgccccatcagaggtagcagggtggtattcgtgagcttctgtgataagtttaaacagatccagaagtttgctgtacgtttcccacagccctgtgacgcagaatcgttcttaagttgtgtggaatgctcatgcggaagcagcggaaccatggacatcataccatttggaagtgattatgtgtgtgaagattcatcagcatctgaatatattgtttctaatggacttcatcacaggctggatgatgcttcaaaccttgaggagcaatgttttgaccacacaatagatgaaccaccaatgaactaccacgaggaaacagaccagcatgttcttgaacctctcagtgctagcaacactagtaacaactctgctttccctcctagtttcaaccaaatgctgaaaagttgttcaattgattatgaccaagaggaaccctgtccattggctgcatcaaaccatgtccttcaagaggtgtatgtgctggatacttctcatgatgttgccaatgaagaaaggactgctggtaaaggaatggatgctgctgaaggagttgatgccagtatattaacatatgacctaatggcacggataaagacatatatggctgatgaatcctttaatgatatgttgctcaagcttgataaagccattgatgaacttggtggtgacatgtcgctgtag

SEQ ID NO: 284 - DNA, 2088 bp, Zea mays
atgagcgcctgcgggggcaccatccccgcgtcgcgcttcctgcgccgccgcgccgccgtgcgggacctgggcggggacgcggccgccggcgacaccgacgccttctgggccgccccgccccgcctctacgacttctcccagcagcagcagcagcagcacacggcccaggccgcgcggcgatcgccctcgccggcgccgaccagcccgtgcctcctcgcccggaagcggcaccagcagtccccgtcgcctcctccatccccgcggcgctcgccttcgtcgcccgggacctgcctgctctccgccctgcaccgcacctgcgtgggctggggcgtcaccaggcgcgccgagtaccccagacggcaccgcccggtttctcccgcggcttgtgggcaggttacggggatgcacacgcacgggcgggcggcggctcggtgcgtggacgaggacgaggagagcaccagcaagaacagcaagtgcctgttggccgtgggcaagaacgagctggaggaggaggtgggtcaagaccacgagagctgcctgcaccgccgccgccgcgccaagaaggccccgtgggccgtcaaggaggagcaggagacgtcaggtgaggcggcggaggagggcgccaagcgcgccaagaggaccccactgaagcatgaggcggcggcggcggcggagagcaagcccgccggcgccgccaccgccaccgccactcccgactccggctcgccacgcggcaacggcaaggtcgaccggtgggcggcgtggcggtacgcggcgggcgaggcggcgctggccaacatcctgcgcgagcgcggcgccaccgccggcaatcccacgccgcgggccgtcctgcgggcgcaggcgcgccgcttcatcagcgacaccggcctgctcgacaacctcctccgccacgtcgccgacaaggtccccgccggcaccgctgaccgcgtccgccgccggtataacccggccggaggcatggagtactggatcgagccggccgggctggcggccgcgcggcgggaggccggcgtcgaggacacgtactgggtgccgccgcccgggtggaagcccggagaccccgtgtcgccggaggcccgcacgctcgaggtgcagaagcaggtggaggtgctcgccggggagcttgccgtcgtaaagaggcaaatggagcagctcgactccaatctggtgcaaatgagcaaggaagcctacatctcatggaaggggtatgactgtatggtcaaggccaatggcaagctggaaaaagaggtgctgtccttggaggagaagtatgagactgcggcacaggtgaatggggagctgaaagagctgctgctgctactgaaggataagtatgatactgtgcttgagaagaatgagaaactggagggccagatggttgctctgtccacttctttccagtccatgaaggaagagttgctcctgcagagaatggaagaacaccctctgctgatgctagcgcaagagccttgggaaggtgacaagcgagaagccggtggtgcgaacaaggctttggtggtgtgtgcaggcgaccagctggccggcgctgatgccttcgatggcagcttcagcagcaaccacagtgcctatggtgacgagaagatggtgctgaggaaacgtatctgcgtgcgggagggagcatgccagtggcctaggtctgctacttccagtggcgctacggctggcagccctggggacctgccggagccgctgacaccgggtgcggatctgatcgtcactgacttcgacaccatgatcgatagcctcgcgctaccgtccatggaggagtacctacaggtcgatggtctccccacgccgacgtctgcctcgtccaccaccgcatctcccaagctccagctcctcccctcaccagcctcgccgagccaggtccagcctctgccgtcaacaaccatggtcgtgggcgacttcaacatgcagctccggcacatggacacgtcgtcgtcgtcgtcatcaggaccgtgcggtgccaaggcgctgaagctcgacgccggagctggaggtggcgaggttggcactgagctggtcctggcgacccccacctactga

SEQ ID NO: 285 - DNA, 3606 bp, Zea mays
atgggttctctcgccgatccgtacgcgctacgctgcgtctccgacctgcctccgccattccgctctatgttcaggttcagatacttcaattccttgcagagtgagtgcttccatgtatgtttcttctcggatgtgaacatggttatctcggcacctacggggagtgggaagaccgtactatttgaactctgcattctgaggctcctctcaaggttcctttcaccagattggaggttcaatttaaataaaggaactctgaaaacaatctacattgcaccgtcgaaggcgctggtacaggaaaagctgcgggactggaacatgaagctgggcccattagggatcaattgcttggagatgactggtgacggtgaattttgcaacactaaagccatccatgatgctgatttaatactcaccactcctgagaagttcgattctatgagtcgacatggtataaaaagtggtagattgggtttcttctgtgacattgctcttgtccttattgatgaagttcaccttctaaatgatccacgtggagctgcgttagaagcagttgtcagtaggataaaaatgctatcgcgacatgataacatgaaatcttttcctctggctaatgttcgattaatcgctgtttctgctactatccctaatattgaggacataggttatgctccagctaaaaatgactttctttttgagaggaaatataaatggaatatggattacagatatactgatgcaacattcaagggggaagtctgcacttattttctgttctacgagaaaagatgcaatcctgttccattttcagttggttttcataatggtggtctttgcttaaaagaccgaggtcttgttgaggggcttttcctcaagggtgatcttcaagttctatgcacaacaaatactttggcacatggcgtcaacttgcctgcacatacagttgtgataaagtcaacacagttcttcaacaaagagaagggcctatatgttgaatatgagagatccatggtgcttcagatgtgtgggagggctggacgtccaccattcgatgatactggaacaattataatcatgacaagaaaagaaacggttcatctatatgagaaccttctaaatggatgtgaaatggtggagtctcagttgctgtcatgtgcggtggagcatctaaatgcagaaatcgttcagttgacagtatctgacatcattctggcggttgagtggatcaagtgctcgtatttgtacatcagaataaggaagaatcctgagaactatggagttaagagggggactcctcaagatctccttgaaaagcaaattcaagatatatgtgtcgataagattcatgagttggtggagtatggactgatttggacagatgaaggagctttcgttttacaaccgctagaacctgggaggctgatggcaaaattctacctgaagtttgatacaatgaagcttatagtcaaagcttctggctattgcaggatccaactacgccgaaatgataagaagattctaaatgacataaacgctgacaaagatggtagacttctatttcatattgtcatgaagaatggaaaaaggaagaagcgtgttcagacaagagaagagaaaatattcttgctagcaaatgattgcttaactggagactctctaatccatgatttatccctcaaccaggaaacaaatgcaatatgctcaaatggatgtaggattgccaaatgcatgcgagaatattttatatacaaaaagaattacagatctgccattaattctatgatccttgcaaatagtctgcatcaaaagctttgggagagcagtccatttctgctgaaacaactgcctgggattggaattgtaacagcaaaggctctgaagactgctggagtttatagctttgagaccttggcaactgctgatgcaagaaagatagaattggccacagggcgcaattatccatttgggaatcatatcaaagaatcaatgtcatcattaccacccaaaattgacatacacatagaggaaactggaaacagacttgggaaatcgaccattactgtaacactaactcgtctatcacaggcagttaaatccagtaaacgcaactgtgctgacatggttgtggcctcagaggaagacaatgtgatcctctttcatgagaatataagcccatattctgtaaaagtttttgtgccatgcccccaaaatgcacgggtgactctgaaggttgatctaatatttgaagaatatgttggtcttgatgtccacaagaagcatgtagtaagcagggaagatggtttgtacgtgaccaaggagcatgggatagataaccttgaacctacgtacaatatcccttcagagatttgtttggttagctccaggacaactcgaacaagccgatctcaatctcacactgaacagaaccctctttccaaagaggtttatgtcatagaagatgatggcgctgctgtgagtgctgtcagtgctctcgagaaagctgatgatgcagtgggaaccataaaatttaacaacttggcttcactggaggtcccaagctttgatctactgcctgaagaagagtatggagctcctggaccagcagaggcagaatgcaaaggtgccacagacagcacgatttttgatcacatacgcaaaaagtccaaagacttccccactctgatgctatcaaaatccatggattgctcatatgaacctcttatactgaagaagatgaagatatcaagggaccagtttggagtaaagcatggttgtctgcatgcgggtgaggccaccacaatggattttgatcctgttgagcctagggtctctccaaccaatactgctgagaagttccgcgggatcctgggtagaagttcagaaaggagtcgcatgctgtttggaaaaatggatagcccgtttgagaagagcgagatgctgggcacgacgccagctgaaagttctcttcggttcgcgggtggaaaagacagctcactggagaagaacaagaccctgatcagaactccagctgaaaactctctccaaattgcagcacgtggaaaggagagcaaggtgagcaaggtgctgacaaatctagataaaagccctcttgggtttgcgggtggaaaggagagcaagatgagcaatgtaccgagcacttcagctgaaaactctctccagtttgcagctaggcgtgtcagatcatctgagaagagcaagatgctgacaactccatatgaaagctctcaagcgtttttgggcgaaaaggacagcccatcggagaaaagcaaaatccttattaatagtccagttgagtatcctttcaagaaaggaagtccaggtgaaaatcctttcaaaacatgtagtccagttgaaaactccctcaaatttgcagctcaacgtgacagcccatctgagaagaggaaatcctgcatcagcaatccccttccgcccttccagcaggctgttcaatgcacaaagcaagtaggagttgcaggtcaaccctttgatattaaggaatattgcaaggaaatattgaggagcagaaatgacagtcaaggaggcgatccttttgctggttacaagagtatcttttcttttctatga

SEQ ID NO: 286 - DNA, 1788 bp, Zea mays
atgacgggagcaggcatgaagcttaagatcaacaaggcatgcgacctcagctccatctccgtcctccctccccgtaggaccggagggagtggcggcgcaggttcctcggccgcggccgcggctgtggcggcggggtcgcagcagcggtcccagccgctgtcgcagcaatccttctcgcagggcgctgtggggagcggcggcgcgtcgtcgctcctgcactcgcagtcgcagctatcgcaggcctccctcgacgagaacctcctcacactccacctcgcttcgcccgcgcgcgaccagggattcaggttgcatgacgactcatcaaagaagatgacatcgttgcctgtcacctcagcttcttgtgtgcgagaagaatctcagctgcaactggcaaaaacatcaagcaaccctgtccatcgatggaacccttctcttcctgatagtagatgcagtggtttaacaggtgtggttcctgctgaggatgttgagcgcaaatttcagcatatggcaagttcagtgcataaggtagggatggtgctcgattcagtgcaaaacgacactatgcagttaaacagagccatgaaggaagctgcactagattctggaagcatacagcaaaagattgttgtcctcgacacttcgatgcagaaaaatcttaagggacaaggtgatctcaaagtgcttgttgagagcaacacaaaaaacattgctgatcagctggctgttctgaactcccactccaacaaactggttgagatatcctcagccctttcagtcttgccgaaacaaatagaaagagatttaaagcaacaacagagtgacatcttcagaatttttagaaacaacatggaggagattgctagagctgtcaaatctctcaacagtaagatcgatgcaatccaaatgccaacagagcagagatgcacaaccaatggaaggcccctgatgaaccaactaccagtcgatagaaacgaaaggcctcaggtgaaccaaacaccagaggtaacccgggtgagccagacaacagtagcaagcttagtgaaccaagcaccagcagcaaatggaaggcacctgatgagcaaaacaccagcagcaaatgggaaaagtgtgatgagacaaacaccagcagaaaatggaaggcacctagtgagccaaacacctgcagcaaatggaaaaactctgaagagacaaacatcagtaacaaatggaatttccctgatgagccaagtaccagcagcaaatgggaaacctgtggtgatccaaataccagcaccaaaaggaagacctatgatgaggcagaaaacagcagaaagcggaaggaccgagatgaacgaaatacccgtagcaagtggacgaccccatacaaacaaaatacccatagcggaagtgcatcccgcacctttggtgtgccctgcaaagcaggtagcaacagacccgaagcccaaggtagacgaggaaaagctgaaagcgcttccccaaaagctaactagttctagatccagggtggcacctaaacaggaagaggcggcaaatacaaaggtcatcagccgggcagcggcaactgagaaggtggtgatattcatcgacgactctgacgatgacaacgacgtccgtgcttcctgcgtgatcctcaggccctcgggatcaggcagcttaggtgagagggaatgcgacctgatgaaggtgggcgcggaggagagccaggagatcccgcggagggccaggaagcggaggagaagagaaatgcaggccactgtgggtgtggcatgtatgccgctgcctgcctga

SEQ ID NO: 287 - DNA, 1809 bp, Zea mays
atgttctactcgcatcagcttctcgcgcggaaggcgccgctcggccagatatggatggcggcgacgctccactcgaagatcaaccgcaaacggctcgacaagctcgacatcatcaaaatctgtgaggaaattttgaacccctcggtgcccatggctctgaggctctctggaatcctcatgggtggcgtggtgatcgtgtacgagaggaaggtgaagcttctctacactgatgtctctcggcttctgactgagatcaacgaggcatggcggatcaaaccggtcacagaccccaccgtcctccccaagggtaaaactcaagccaagtatgaagcagtaacactgccagagatcaatatggtggtggaacagcccatgtttttctcagagcctgatggtgccaagttccgacgaatgggattggaagatctggatgaacagtatgttcaagtcaatcttgatgatgatgacttctctcatgctgatgatcgtcatcaagctaaagcagtgaatataaccctggtcgataattttgagtctgggcttgcagaaactgatttattcaatcactttgagagatttgacatagcagatgatgagaccacagtcaatatcactcctgatgagtacccacaagttccaagtacgctgattccgtcaccacctaggcaggaagacattcctcaacaagaagaaccgtactacgctgccccctcccctgttcatggagaacctcaacaagggggaccagaggaccaagaggaacagaagatgaagcaaccaccgaaagcatcaaagcggaaagcacgttgggaagtcccacgagtaattatggacaataaccagatgatgatcccaggaaacatatatcagacatggctgaaggatgcatcaagccttgtctcaaaaaggcgtaaacttaacagcaattttaattttattcgatcaaccaagataagtgatctcatgcacatccccccggttgctctaatatctcatgacaacttgttctcagaattatgttatcctaagccacttatgcagctctggaaggactgcactgaggtcaagtccacaaaagcttcttcaggagggcagcgatcatcatcacaagaaccacaaccgaaaaactcaccacctcaggctgggggagagtatgagatggaaacaggtggtctgccgatggatttaacagatggcattgaaaaactcagggcaaacatgagtgcaaaatatgacagagcttacaatattcttcacagtgaccatagtgttactcctggaagtcctgggttaagtcgcaggtctgcttcaagctctggtggctctggatcggcgtttatacaattggatccagaagtacaattgccatcaggaagtggaaggtccaaaagggggcagcattcatctgcaagaagcttggggaatcttgatactgttgaggaagattttccactggagcaggaagtgagggacttcaagatgagaaggctttcagattatgtgccaactcctgacctactggaagaaactgaaccgactcaaaccccatatgagaggcgctccaatccaatggacaagatcacagaaacaatccagtcgcatctcaaacttcatttcgataccccaggtgtcccacaatctgaatccttaagtcatttagctcatggaatgaccaaagccagggcagcccgactattctatcaaatagctgttttggcaacttgtgattacatcaaggttactcagctggaacggaaaggagatgaactgtacggagacatcttgatctccagaggattaaagatgtga

SEQ ID NO: 288 - DNA, 1491 bp, Zea mays
atgagatcgggttttaacgaggaccaaaagttttcttttagaagctctgcttgtaagatgatcagaacgctggtttcacttatgagaaccttggacccaatgcctgaggagcgaaccattctaatgaagcttctatactatgatgatgtcacacccgaggattatgagcctcctttcttcaagtgttgtgctgataatgaggccataagtatatggaacaagaaccccttgaagatggaagtgggcaatgtcaatagcaagcaccttgtgttagctttgaaggtcaagagtgtccttgatccatgcgatgatgacaatgttaacagcgaaggtgatggcatgactgtggataatgagtctgatcatgatgatgacttttctgacactgaggttcatccaccaaaggcggatcattacatcatagctcctaatggtaagcatgtcctcagcaatgtttgcatttgctgttttggaattattaatagaagttttctcacagaaggaaaagacaaagatcaggacactggtactatttcagaagatgatactcaagatactgctcatgaggaagagctaacttcccaagtgaaggagtggatatgctcaagggacagcggaacaattaatgtttcagatgtcctttctaacttccctgacatatcaatggaattggttgaagatataatggacaggctacttaaagatggtatactatccagggcaagcaaagatggttatacggttaaccagaaggctgatccaaaaacaccacatataaagaaggaggccatcatgccagatgtatcaccaactaatgtaaccaaacacaacaatggggatctgctatatatgaaggcattatatcatgcacttcccatggattatgtgacaatagccaaacttcaaggaaagctggatggggaagccagccaaaatacagtccgaaagttgattgacaagatggtgcaagatggatatgtgaagaattcagccaaccgaagactgggcaaagctgtcattcattctgaatctaccaacaaaaggctccttgagataaaaaagatactggaagtcaatgaaggcgaaaagatggccattgacaccaatacagagcatcctgagcctgagcacaaagaccttctgagagtctatgaagtgggagatggctccactatgggttgcctccactcaattggatctgatcttactcgtactcgggagctgccagagctgcaacagaatgtgtccatgcagagcgggcaagaagcttccacagtgggtaaggattccagcaggactccaacaagtgtgcgtgagctggctgtacctgtttgttccctggaaagtggagtgcttggaaagagaatcaaaaggtctctaactggtggaaatgagatgcagtctacccaggacaagcgatccaggaaggctagcatggtgaaggaagcaatactccaacatgtcaagtgccaaaaccctcaggctcagtga

SEQ ID NO: 289 - DNA, 636 bp, Zea mays
atgtctaagaagagggggctttcgttggaggagaaacgggagcaaatgcttcaaatattttatgagagccaggaattctttctgcttaaggagctagagaaaatgggtcctaaaaagggagtgattagtcagtctgtgaaagatgtggtgcaaagcctggtggatgatgatcttgtcttgaaggataaaattgggacttctgtgtacttttggagtcttccaagttgtgctgggaaccagctgaggaatacttacaacaagctggaatctgacctttcaaactctagaaagcgttacatggaccttgttgaacacagagataacttgaaaagaggccgggaagactctgaagagagggaagctgctttggaggagctgaagactgtagaactacaccataagaaactcaaggaggaactggctgcatatgcagatagtgatccagctgcagtagaagcaatgaaggatgctactgatattgctcattcagcagctaacagacaacattttcactttgcaacaatggtgttcaaccacattcccagaagcaaaagaacaactggaacatatgtacagggaggtatgtttctgtcttgttctgttttgaccttcttgtgtttgcagtatgctgcctga

SEQ ID NO: 290 - DNA, 381 bp, Zea mays
atgccgattttcgcattagtggattggaacccagcagggcttgctatactgtgcacttacaaatacggaagcatatcaatgggcctagagtcatacagatatgcttgcaacgtgaaatggctcggggtgagaggaggtgatctgcatcttatccccgaggacgcgtttcaagagctgaagccacgtgatctgcagattgccaaaagcttgatgtcgtcaaagttcctgcaggagagtcacagagctgagctggcgctgatggtggagaggggcaagcgtgcagacatcgaagccctctactcccacgggttcgatttcttggggaagtacatcgcgagaaagatccgcagggcgattacatctgatgatggaatgatgtaa

SEQ ID NO: 291 - DNA, 798 bp, Zea mays
atgccacctcgtcgagccaatgaaaactttcttgaagcctatgaagttattttaatattggatgaccgtgaaaaattcgggtctcgttcaagaaaagttgctgataacatttgttccctgagccattttgctgtggatgtcaggcaattgcctgtgggagatggtatttggattgcccgtcataaggaagatcacacagagtatgttcttgatttcattgttgaaaggaaagaggttatggatttagatggctcaattgaagacaaccgatatagagatcagaaattaaggatgaagaaatgtgggctgaggaagttgatatatcttgttgaaggtgatctcaaccgtgcaccaaagagggttaaaacagcctgtttcaccactgagattctcgatggatttgatgttcagagaactactgggtttgccgatacccagaagagatatgttgatcttacacgttcggtaatagcatactatgatgcaagtttctcgatcgttggtaaagcttcccctgtttgcccaacctacgatgacttcaagagaaagtgttatgatcttaagaagaaaacagtgagcgacatatttggctgtcagcttatgcaggtaccacaagtaacagaagaagctgcacaagctgttgtagagctctatccaacccctttgttactggcaaaggcatactctatacttggtggcgatacctctgcacaagagaagatgctaaagaagaagaacgagatggtaaatgcaggagcaagccgaaacatatttcaccttatctggggtgacggatga

SEQ ID NO: 292 - DNA, 897 bp, Zea mays
atggcggcggccggtggcggaagggaagccaccacatccggctgtggtctcaagcgccgctacgcaccacacgaccaggaggaggagacgatgaatcaagatcagccttctaaggaagatcggtgtgggcgaatttggagtgggatcgacttgctcaaggacgtcactgaaaacaagcatgtcctacctactggacttgaaggcattgacagacttcttgggggcgggctgcgccaaggtcagctcacagaggttactggaccatcatcttctggtaaaacacaggtttgtctacattctgcttcacatgctccagtgaagcatacgggtgtggttatgtacttggatactagtaattctttctctcctagtcgtattgccaccataattgatggaactaacgacctatctgatcaaaaaggttttgacttgctgtctaaggagaggctcaagactgtgatgcaaagcatcatctgcgagtctgtgtttgatatatttggtatgtttgaagtactacatcaacttgaagtttctctactgaatgaaaaggtaataggtgatggcaggagaatttgcttacttataattgactcaatatcatccttacttgctcccattattggaggcaagtatccacaagggcgatcgatgatgatatcactggcgatgatcctaaagaagttagcctatgagcataatctagctgttctggtgaccaatcatatggtttcagctggcaatggtgctgtcaagcctgctcttggtgagagctggaaatctgttccacatgtccgcctgatgatatctcgtgaacatagtagtaatatctgcacgggaactgtgctgaagcacacactactggcttctggccgtactgcaaaattcgtgctgccctga

SEQ ID NO: 293 - DNA, 2604 bp, Zea mays
atgcaaaagcactcggggcttcggagcctcgaggggttccgatccctcgttggatccacctcgacagccatgaaggtcgcgaaccccaggccctccccggatactgggggtatttcgtatgggagcttcgccaaccttaagatcacagcagagaaattagtcaaggagcaggcttcagtgaagactgatctagaaatggcgcatgtcaaattgagaagagcaacagaacagataaacattatagagggaaaacttcaacaagctttgaatgaaaatgcaaagcttaaggtgaagcagactgaagattcgaagctctggcagggattagattcgaaactctcctcaacaaagaccttgtgtgatcaactgactgaaactcttcagcagctagctagtcagacagaacaagctgaggaagacaagaagttttttgaggagatgcttgggaagaattccaaagctctagatgaattcaactgcttgttgcgtgatttatcaacaaaactggagtatgcggaacaaaagataatttcagggagacaggagatgttgcagatcaaacaagagaaagaagagatggatcgaagttacaagggacaactgtattcaaatgatactacgataaaggaaaaagattcgctcatcaagcagttggagggttcacttgatgataataaatcccgcttgatatatcttgactcccgcttgcaatgcatggagcaagaactgaagctaaaagatgatgtttgtatcagcctgaaaggaaacctagctagcagtgaaagtgaaaagaacagtttggagcttatgaataagggacacattctggaaattaaaaaactatgccaggacaacaaggatcttaatgaattgtttagcagcttcatggttaaagtaactgagctagataaagaacatgcctctatgtcaagtcatgtgtctaggctgatttcttcatttgaaagattctatgaaatggcccaagaggagaaaatgctaatggcaagatcttctaaggataaatttgaacatcttcaaagccagtatgtagatttgacatcagaaaacaatgctctcaaaactgaaattgaagaactgaagtccagactcatagagttgcagagaactcaagaaattgttatggttcaacatgttgaagaatgccaagtggctgaagataagatcagaagattagagtctgaagctgaagtttctgcctccaacataaatcagttagaaaaattagcttcagaactacaagggagaattcagaagttactagaagattctacctttgctgaaaatcacaagcaagagttgcttcaaaagattttgaagctagaatcagataatcaggaactcctaggacaaatgcagtccattatggaagagaaatcaaataatgctgaatctctgcatggagagataactaagcgtgaccagcaggttgatacacttgagaatcagatcaaccagcttcgtagtgttctggatgagaaggagcaactctatctttgttctgtacaaaaagagaagactttggaggaacagaaattacaggtcgaagcattgctttctgcaacagagtgcaaacttagtgatgcaaaaaaacagtatgatttgatgcttgaaggcgaaaagatagagctatccaagcatttgaaagagctatctctcaaaaatgaccaggcgatcaatgaaatccgtaagaaatatgaacttgaaaagattgaaattactaatgctgaaaaagaaaaggcagaaaagctcataagggaaattgaaaacaaatgcaacgaaaagatatcacagaacaagcatgattctcagaggtatttgatttgccttaaggaggaacatggcacaacggtggcgagaattcagcaggataatgagcataaagagtcaactctccgggcttatcacaaagaagaactgcagcgcattcaatctcaggctgagaatgaaatgagggagaggttgtcattgctcagaaaagagcatgaagttcaaataaaatcactaaggatgcatcatgaggaagaatgccagaggatgcaggaggaactggagcttcagaagtccaaggaggagaagcaaagagcattgttacaattacagtggaaagtaatgggagaaagtcaacgagttgatcaagaagtgaactctaagaaggaatactctgtttcgtcgattaggaggagcgacccatatggaagaaaagaacaagaggtccagttggtaagtccggagaccaatcggaaggacgtaaacttacctgggattttacaatcaccaatttcgaacatgttgagaaaggtagagaaagtgtctcaggatattcctaaacatagaaaggtaacccaccatgaatacgaagttgagacagcaaatggaagaatcacaaagcgcaggaaaactaggagcactgtcatgtttggtgaaccgaactctcagaaaccattgcataatactactgacaaagatgttaaaaaactaaaaaaggttcctacaagatcccgtgcacatcctgcaaacattggtgaattattctctgagggttccttgaatccgtatgctgacgacccttatgcttttgactag

SEQ ID NO: 294 - DNA, 2037 bp, Zea mays
atgaggcgccggaacctaattgtgcattctgattccgacgaggacgacggcgagggcatgaccaccgccacaacccccgcctcagtttcagcttccgtcgctagcggcggcgtaagcggcagcggaagcgtcggccggccctcgccccaaaacctcagccccctaccagtccccttcccgtcactctcgctatcttctgcccccttcgtcatctccgatgacgacgaggacgtcgacgagatcgtggaccctgacggggactctcccatcgttgacgcccctgaggtcttctccccgccagctcctcccgcgctccatgctcccgctcccgctcccccttcccctccccctcctatcactaccccgtcccagaccccaatcccgactccaccttcggcacggaccccgaccccgactccgccttcggcgcggaccccgaccccgactccgccttcggcgcggaccccggcctcaatagcgcctccgcacccgtccccgctgagcggccggttgcgcccggtggacgagttcctgcggcggctcgggttgcttctgcggccggactggctcgagtcctgcgctgcggggattcccggcttcgacggcctcggtggtgttgaggcgcaggccaggcggtgcttcgagcagtttctcttcgccgatatgaactcttgcggtgctggggtgctgccggagggcgtcgggggcatgcacgctgagttccttgatggccccttcgtgcttcaggttgatgaagttgtcaatatttcagttcctttaaaggaaaggtatcgtgaagcaccggcaggacccaaaaggtgtttaaaactatcaatgacagatggcatacgacatatatttggaatggaatacagacccatcaaagacctgacagttcttgctcctgctggtttaaagattattgtaaggaatgtacacacaaggaggggtcttcttatgctagttcctgaggctgttgagattcttggtggtgtagttgacgaattggaagcagcgcgtgccagacttgtttctgaagtaaacaaaccacctcgtggcaaaagtaaacagggtggattatctttgtcttcaagagctacgcgagctgcctggccatgtagcaccgatattacaaatggtgttgcgcaggggatctcaatgcaaagagcagttaattcctcgtatccaacaggatcaggtaatgctttccaggttggtggagctacagaaactgtggttgaagagcttgttagccctcttgtagcaaaccgtgtccaagaaatcaacatgcagggctcatatgcttctcttaccagggaaactactgaaacttctatgcatactacccatgaatatgatcccactcatatcactgaaaaaagtacagggaccgtcatggaagaacgtcctgatcctcctattctagcaaacagtgtccatgaacaaatgcagcgagtccaacctgctaacggtgcacaatcttcaaatgttggcaagatcaatcagatggaacagtctttcattctaagcggtgaaaatgaaaaaccatttacatacatatacagcatgcttattgactggggtaggcaacaggacacaaaagcctacattcaaggaaaaatcaagggtctgatcacttctgtaaaaaaatttcaatataaacaacgcaccaagtacgagctttatgtatatatagatgatgggagtttcatttcagaggccttcattgacagtgatattgtgaataacatgcttggcctttctcctggagaggttactgctgcacttgctggtgaattagagtttgcatcacccagtgaagtgaaagaaactttgaaaggatttcagaagtttttggtgaagtttgagggtatgatgcttatcgagttaaacaagaactctcctgttcctgttgttcgtgagttaaatgaaggttgctcaagttctactgcatggcttctgctcggaaggctgaaaacaatttcttctcagaagaagaccatccaaactcaggatattatggacaccactccatga

SEQ ID NO: 295 - DNA, 2070 bp, Zea mays
atgccgtccaggcgcgcgctacggcggtctccgccgccacgacagagcccgcaggcagcggcggacgcgaaggaggcggcgagcccgtggctaccgtcctcatcctccacctcgtcgtcttcctcctcagcctccgcgctcgtcaggcgctccgccgccttctcggcggctgggccgaggggcggatcggggacgcgcgtgtacccgttgcgggacttcccgggcggggacgcggccgcgctcggcggtgcgttccgggacaacgtgcggtggctcctgaagcagtggagctgcgttccgggttccgtgtcggcgtggcgcgcgctgctgtcagacgagcggacgggcgccttagtccccgtcatcgccgtggaggagctcgcggcatcgtcgcccttgccgctctgcgatctctgtcgctgcgccggttggagccaccactgggtgtcaaagcggaagtaccatttcatcattccggcagtggtcgactgggaccagccattcagggctgatgggttacttgggcacagcgagcacctcctacatggtctgatccatagtaatggctttggtcaccttctcaccctccgtggtcgtgttggtggctccactttcctctctggctgccagatcatggatatatgggatcaactttgcacagctctccgtgtaagagccgtctctgttgtggacttgacccagaagtactctgtggacctccgcctcctgcttggagtggcacaaagcaagacttggttcactcgctgggggtactgccttgccaagggttgtttcagcgtgtctaggtccacttatactgctgcacttgaagcccttgctgccctgcctgttgattgtctccgtagtcgtcatgtccgtcgtgtggtcaccatctaccgccgcctctccagcaaacctctggttacagtccgcgagtttctcctctgcctgcttgattggaagcaccgtgagcccccgctttctcctcctcccgtgaaggcatcctcgcggctgatgttcttgctgccaaagtcatgtatgatgaagaggcccaggcagccatgtcaacgctttgaggacgtagttgacctgcttgagtgtcggtggtcaaagaagcgtctgcttagtgctgcaaatgttgttgttgcaaagctgcgagagcatgcggatggcacaaagataacacggcaagcagtgcgagatgctgcaaggggtggcatcggtgacactggtctcctggacttcgtcatcaagtccctcaataacactgttgttggtaaccacattgtgcgccgcgtgcctgaccctgagaatcgtgtgcttcacttcagccttgaggaatatgctgagcctgagccacagccacaggcagatcatgagcttgaaccagtggaacttgatgcagagaacacccctcctgcagtccgatggccaaacgcagccgaggcggagcgggatctgcgtgctgtgtaccgagcaatggtgggggcacgcagtgaagcagcacaggctgtactggactgcaagcactgggtgaaatggtggggcctcagggacgagtctgatgaccagctaaggttccttgttgagtggcgaccacagccatgggaggctactgaacttacaaggccaatgccgcctggggatattgtggtagtaccactgcatgcatccataggcgagctgcttgttgaggcagagcatgcactgagggatacatactgcttctttgagaatttccaggccgagtcactggatggcattactggggataaatgggatccggtgatgcttggtggagcagagtctggtgacaccattggtgtgcacggccacggagctgacatggagactgggctgcggtgccagggaggtgcagatgcgtgggaggtgcagtgcgtttgtggtgcacaggacgacgatggggagcgcatggtggcatgcgatgcatgcaatgtctggcaccatacacgctgtgtcggcattgcagatggtgctccggtgccaccattgtttctctgcatatcctgcagtggcgcgctaatggccgctggaccaatttctggatga

SEQ ID NO: 296 - DNA, 3381 bp, Zea mays
atggcggcggcggacggggacgccttgatcgcggcgtttgcggtgtccaagggcggcatcgtgctcaagcacattttcctcaacgcaccaccgccggaggcgatgtgcgggtccggcggaagagaagtggagagtgatgaggaggacccgccggtgatggtgggtcggcaccccgactgccacgtgctcgtcgaccaccccagcgtcagccgcttccacctcgagctacggtgccgacgtcgacagagtctcatcaccgtcaccgacctccactccgtgcacgggacatgggtttcggggcgacggatcccacccaacacgccagtggatctcgctaccggtgacacgctgcggctcggggcctctaagagggagtataagctgctctggctgtcgcttcgtgaggcatttgagatggacgatctgatgtatatgccatcgctgcctgaggaggacaaagaggagccatatgttaaggaaccaagcagcaagttattgcctgggcacagggattcagtgaacatggagacccatcaggatacaagtgaacaaattgtgtctgaagacattgcatttccagccaaagtggccccctcagcacctccattgtctgagttccttcaacctttttttgtggaagagcattcactttcccaatttcatgagaaaagaaacggagtgacagaggaaaagttggtcgacaagaatcaaatttcagaatcttttggttcgttgatcatacaggaaatgccaggcacactgacaaatgctggaaaatcaatccagtcaggcgagcaggaggatgcctcaaacaaagtgtccaagaggtccaagttgaagtcagtcaaatcacttcgtgttgacacaggcaggagcagcgagagaagcagcactctgagccatagctttcagaagggagaccaaaatgatattgttgtatgttctcagagctgtgggacagaatgtgcggtatgtatagctttatttggtatttctgaaattgaaaaggctgaagaaaaggaagagttgattgctgaagataacgttgacatgaatcccccggccagcatgatcatggagggaaatatgaacgagagaaaacctgataattatatcccacaagatccaattggtgcaaagctgcagaagaaactaggcttattagattctgctctccctttgcatttcaaagatgatgtgttcgccgacaaggaaattccacaatggaatgttgctagtgttcatacagaatctgagcttctttcagaatatcttataataccagaagtgaagcacgatgacttgaaccatcttaacttggaggaaggtctctcaaaaagcgagaatataaacccaaataagattactgagggccctgggaactgtcagctcgaagggaccattcgtgggaatctatttgacaatttggatactgatggaattgaagaaggtgaagagatctgcccactggacaaggatgaaatcacccccaatggatcaggtaacataataatggagaggagcaatatagttttaaagcctaccatttcccaacagttgatggattctatttcccctctcaatttagatcatggcgacttttctgaaaatgagaactccatgctgaacactggagatcagatgaaattaaatgaacctgtctctgagaatcttaacccattaattccaactgatgaaaaatatctgaagagccaaacggaggagtgtatgcccatttcatatctggaattcaaagatgatatccttctggatagggaaaactcagtgctggctccgagaaagtacgaggctatgtcccctgtgaggcaggaaaatctgttctcagacaaagagaacgtgactcctgcctctaaggtgaagaccgttgttaggggagttcttggtacaaggatggataattcagtgtcagcagcaaatgcttcaaataagaataaagttcttgggtcaagggtcgataattcagtgtcaacagagaatagctcaaataagaagcaatgtgaattatcatcgaagtccaaaaaagtccacacagtagattttgatgttttctattcggataaggagaacttgactcctatatcttcaggaggcatgaaagcaaggaagtgttttcccaaggacctctcagtcgacttagaccaagatcaggaagcattctgctcagacaaggagaacttgacaccactatcttctgcagctcggaaaacaagggacatgtctggaaaccttacacgagttgaaagtgcggtcacaaagaaaagggttgttggtaggctccccttccagactcttgtgtcaaattctcctttgagacctgctagctcgcatgattgtacctgtgctgttgctagaccagctggcgttgctgctggtgacttggcgatcaagttagaagataaattgaacgatctctcatgtaatggccacgaatcaggtagtgctggagaaggcatgaaaacctggaccatggtggctaatacagacagtcttcttgatgacgagtctaggaaggctattatgctgctaaaaggcttaaaaggaactcgcctgttcataccaaggattgtgatcagggagttggattccatgaagcagcgggagggcctgttcagacggtcaacgaaggcgacctccatcctgcaatggatcgaggagtgcatggcaagggagagctggtggatccacgtccagagctcggccgacatgttcccggtagcaccaaccccgcccgcgaccccttcagcgcagcgcatcgacgaggagatcgagatcagctccggctccttcaacccgatgatggcgttgttcggccctcgaagctccgccgcgctcgcggatatgatatctcccagacccgaggaccgcgtcctcgactgcgccctcctcgtcagtagggtccggagcaacgagaaggtcgtggtgctgtcaaacagcgtcacgctcaagatcaaagccatggcagaggttagtacggtaaccacccaaacccaaccctgcctgcttgctgtgtgcgttcgaactgaacctggttgtgttgcgttgcccgcggcgcagggcctgccatgcgagggagccaaggagttccgcgagtccctcgtggacccgtcctccaggcggttcatgtgggcggccagcgccccacgggggtcggcctggtcctgcctggacgcgtccgcgctggcggagaactactacaacagccgccaccacgctatgaagcggagggttctggtggcggcgaggccctccgagtccgaggccgccaagggcctgaagctgatcctgcgtcacaattccctgtacgcgcaggccacggacgccgtcaacaagacgccgctggtatcgctggccgcggtgtga

SEQ ID NO: 297 - DNA, 1224 bp, Zea mays
atggcggggagggataagaggcgacgagcggcgccgctcgaaggcgacgagcagcagttgcggcggaggctggaggaagcggcgctcctcctccgcaggatcaaagggcttgtgcgctggatcgtcgaagaggttgccgccggccgctccccgtctatagtgctccaccggtaccggaactattgctcctccgccgactctgcgtccccgtccccatgtgcctgcagctacgacatccccgtcggcacggacgtcctctctctgctccacaaggactaccacacctcccgcctcagtacgaatacatctaaatctttgcatttatgtgatcacactaattactttctgatgcgttgttcatgcgtagatgtgctcctgagggtgctgttcgtggtgcagcagctcctgcagcagaacaagcactgctccaagagggacatctactacatgtacccctccatcttcgtagaagtagcagttgttgaccgtgccatcaacgatatctgcatactcttcaagtgcagccggcacaatctcaacgtggttcctgtagtgaaaggtttggtgatgggctggataagatttatggagggcgaaaagaaagtgtattgtataacaagcgtcaatgctgctttctccattcctgttgacattgaggcaatcaaagatgttgttagtgttgcccactacatacttgtggttgagaaggagacagtgttccagcgtttggccaatgacaagttctgtgaaagaaatcgctgcattgttattacaggaagaggctatccagatattccaacaagaagattcctgcggtaccttgttgaactgctgcatctgcctgcttattgcttagtggactcagatccttatggtttcgacattctggctacctataaatttggttccttgcaattggcacatgatgcaaacttgttgcgtgtccctgatatacggtggcttggagttttcacatctgattttgaagaatattgccttccagactgctgcctacttcgtttgtcacctgaagataggaggaaagctgaaggcattcttgctaggtgctatttacacagggaagccccagaatggaggtcagagttggaagcaatgctgcaaaagggtgtcaagtttgagattgaggcactatccgcaaattccatttcctttttatcgcatgagtacattccccagaaaatcaaacaaggcatgcatttataa

SEQ ID NO: 298 - DNA, 1668 bp, Zea mays
atggaggggaaggcggtagccgtcggttgcggtggcgcccgcgtcgatccggcggatgatctcaagtacatctccgggctgagcaccattctcgtggccaccatccaggaagtgaaggaccaggtctcccagatggagttcatcttctgcagccagctcttcccgcacatccaggccaagtcgaagcttgtccaggcgcatctcgccgacacgatgaaggccagtgaggttgagtggaggaagacggaggctggcctggtgaagcagctggaggaggtcagccgtggtaagatgctcgcggaggagagattgctgcaactgggcacctctcttgaggagatgaagaggaagcttgtggattcggagcaattggctgcgaggcatgaggcggagaagaaacagcttctggggaggttggaggatgaaacgaggaaaggtgaggtggtacgtcagctccaaagggagattgaggagaaggacgctgaggtggtcagggagagagaggcacatcagcggctgctgcaggaatttgagcaattggctgcgaggcatgaatctgagaagaaacagcttctggggaggttggaggatgagatggggaatggtgaggtggtacgtcagctccagagggagattgaggagaaggccgctgaggtggtcagggagagagaggcacaccagcggctgcagcagcaggttgacctgaaggataagaatctgcttctggagcagagcaagcggagggacttgattgaggattacactcagctgaagacaaactacaagcatttgaagtctcagtacacctttcttcttgggaagattgaccagcatgaaggctccaagcctcctgaggacattcctgcagatagaagaaacactgaaagtcctccaagtaagaggaaattcaaagatttggagcacacaaacaaggagcgcatccaaatccttcccaacacaagggacctgaagaatgactctgctccaggtgccaaagcccaagctgcccaacatgctagttcagtcaggagtccaatcagaaactcacaccttgccgtgccatctcgcccaatgaatccattggcaaatcattctgccaacaattcaaaactacaagcttcaaccagtgtcgccagcccatgtctaaattggagggagacccgtgcacgcaaagaacaaggtgttgctgatccacacgatgatttccttgatacacctctggaagctgtcaagaataccatcaggaaccctgcaactcccgaagaagcactggcacttgccgcctctcctcaagttatggatttcgacaattcagatgatgaaacccaagatctgaatattgcaactcaagccctccggcacatccccaatatgccagttaccaagcagcaaaacacaatatcggtacatccaccaaagaaagacttcaaatatagagaatcagtgagaaagaaagctgaccgggagaacctgaaaggtgtcgagtgcaagcaatgcaagaagttttatgatgctgttcttcctggtggtcgtgcagatggcgatggtgcaggctctacaagcttacgatgtgagcaccacgatggtgtgtcaaggcatcggtacaggtacgcgccgcctctgacgccggaagggttttggaacattggtttcgaatcagaaatgtag

SEQ ID NO: 299 - protein, 340 aa, Zea mays
MSSSSAHQKASPPIEEEATEHGPFPIEQLQASGIAALDVKKLKDAGLCTVESVAYSPRKDLLQIKGISEAKVDKIIEAASKLVPLGFTSASQLHAQRLEIIQLTTGSRELDQILDGGIETGSITEMYGEFRSGKTQLCHTLCVTCQLPLDQGGGEGKALYIDAEGTFRPQRILQIADRFGLNGADVLENVAYARAYNTDHQSRLLLEAASMMVETRFALMVVDSATALYRTDFSGRGELSARQMHLAKFLRSLQKLADEFGVAVVITNQVVAQVDGAAMFAGPQIKPIGGNIMAHASTTRLFLRKGRGEERICKVISSPCLAEAEARFQISSEGVTDVKD

SEQ ID NO: 300 - protein, 301 aa, Zea mays
MTGRPPLYARSPARRQAFASNEHPPPGKRTLPPSLPAMTGRPPPYARSSARRQAFAGDEHPPPALLGPPPLVDPSAGRGVCLMSTSWRDKQRPELVNFVATFLATNMYRLNFMSLSPDFIFNNGGLSVAFAFETDWLPEREAAVFSRVTTLKRQFKYLYVVVVVRSAEQNESFNQSYFKYGMELGCPTFVPVCDPAMGFEKIVRIAHARGVCKQKDNIATMRIEREQAVQCMDAFLRVLTSIPGIDSHDANALAQAIGSIEAIAKASKEFILENTDLSTEKAERIVRFFRDPQYFLSPKLN

SEQ ID NO: 301 - protein, 347 aa, Zea mays
MADAADSSMALVHSSLADSVLTSPRTLRQGQKWEVEYARYFGTPRRDPTAAPPSGLRYIMRGVHRHQGTWIPASCPASLCVCHPSLPSAVPVLTISIGDVVFEEHFVSILNFSWPQVTCVTQCPIRGSRVVFVSFCDKFKQIQKFAVRFPQPCDAESFLSCVECSCGSSGTMDIIPFGSDYVCEDSSASEYIVSNGLHHRLDDASNLEEQCFDHTIDEPPMNYHEETDQHVLEPLSASNTSNNSAFPPSFNQMLKSCSIDYDQEEPCPLAASNHVLQEVYVLDTSHDVANEERTAGKGMDAAEGVDASILTYDLMARIKTYMADESFNDMLLKLDKAIDELGGDMSL

SEQ ID NO: 302 - protein, 695 aa, Zea mays
MSACGGTIPASRFLRRRAAVRDLGGDAAAGDTDAFWAAPPRLYDFSQQQQQQHTAQAARRSPSPAPTSPCLLARKRHQQSPSPPPSPRRSPSSPGTCLLSALHRTCVGWGVTRRAEYPRRHRPVSPAACGQVTGMHTHGRAAARCVDEDEESTSKNSKCLLAVGKNELEEEVGQDHESCLHRRRRAKKAPWAVKEEQETSGEAAEEGAKRAKRTPLKHEAAAAAESKPAGAATATATPDSGSPRGNGKVDRWAAWRYAAGEAALANILRERGATAGNPTPRAVLRAQARRFISDTGLLDNLLRHVADKVPAGTADRVRRRYNPAGGMEYWIEPAGLAAARREAGVEDTYWVPPPGWKPGDPVSPEARTLEVQKQVEVLAGELAVVKRQMEQLDSNLVQMSKEAYISWKGYDCMVKANGKLEKEVLSLEEKYETAAQVNGELKELLLLLKDKYDTVLEKNEKLEGQMVALSTSFQSMKEELLLQRMEEHPLLMLAQEPWEGDKREAGGANKALVVCAGDQLAGADAFDGSFSSNHSAYGDEKMVLRKRICVREGACQWPRSATSSGATAGSPGDLPEPLTPGADLIVTDFDTMIDSLALPSMEEYLQVDGLPTPTSASSTTASPKLQLLPSPASPSQVQPLPSTTMVVGDFNMQLRHMDTSSSSSSGPCGAKALKLDAGAGGGEVGTELVLATPTY

SEQ ID NO: 303 - protein, 1201 aa, Zea mays
MGSLADPYALRCVSDLPPPFRSMFRFRYFNSLQSECFHVCFFSDVNMVISAPTGSGKTVLFELCILRLLSRFLSPDWRFNLNKGTLKTIYIAPSKALVQEKLRDWNMKLGPLGINCLEMTGDGEFCNTKAIHDADLILTTPEKFDSMSRHGIKSGRLGFFCDIALVLIDEVHLLNDPRGAALEAVVSRIKMLSRHDNMKSFPLANVRLIAVSATIPNIEDIGYAPAKNDFLFERKYKWNMDYRYTDATFKGEVCTYFLFYEKRCNPVPFSVGFHNGGLCLKDRGLVEGLFLKGDLQVLCTTNTLAHGVNLPAHTVVIKSTQFFNKEKGLYVEYERSMVLQMCGRAGRPPFDDTGTIIIMTRKETVHLYENLLNGCEMVESQLLSCAVEHLNAEIVQLTVSDIILAVEWIKCSYLYIRIRKNPENYGVKRGTPQDLLEKQIQDICVDKIHELVEYGLIWTDEGAFVLQPLEPGRLMAKFYLKFDTMKLIVKASGYCRIQLRRNDKKILNDINADKDGRLLFHIVMKNGKRKKRVQTREEKIFLLANDCLTGDSLIHDLSLNQETNAICSNGCRIAKCMREYFIYKKNYRSAINSMILANSLHQKLWESSPFLLKQLPGIGIVTAKALKTAGVYSFETLATADARKIELATGRNYPFGNHIKESMSSLPPKIDIHIEETGNRLGKSTITVTLTRLSQAVKSSKRNCADMVVASEEDNVILFHENISPYSVKVFVPCPQNARVTLKVDLIFEEYVGLDVHKKHVVSREDGLYVTKEHGIDNLEPTYNIPSEICLVSSRTTRTSRSQSHTEQNPLSKEVYVIEDDGAAVSAVSALEKADDAVGTIKFNNLASLEVPSFDLLPEEEYGAPGPAEAECKGATDSTIFDHIRKKSKDFPTLMLSKSMDCSYEPLILKKMKISRDQFGVKHGCLHAGEATTMDFDPVEPRVSPTNTAEKFRGILGRSSERSRMLFGKMDSPFEKSEMLGTTPAESSLRFAGGKDSSLEKNKTLIRTPAENSLQIAARGKESKVSKVLTNLDKSPLGFAGGKESKMSNVPSTSAENSLQFAARRVRSSEKSKMLTTPYESSQAFLGEKDSPSEKSKILINSPVEYPFKKGSPGENPFKTCSPVENSLKFAAQRDSPSEKRKSCISNPLPPFQQAVQCTKQVGVAGQPFDIKEYCKEILRSRNDSQGGDPFAGYKSIFSFL

SEQ ID NO: 304 - protein, 595 aa, Zea mays
MTGAGMKLKINKACDLSSISVLPPRRTGGSGGAGSSAAAAAVAAGSQQRSQPLSQQSFSQGAVGSGGASSLLHSQSQLSQASLDENLLTLHLASPARDQGFRLHDDSSKKMTSLPVTSASCVREESQLQLAKTSSNPVHRWNPSLPDSRCSGLTGVVPAEDVERKFQHMASSVHKVGMVLDSVQNDTMQLNRAMKEAALDSGSIQQKIVVLDTSMQKNLKGQGDLKVLVESNTKNIADQLAVLNSHSNKLVEISSALSVLPKQIERDLKQQQSDIFRIFRNNMEEIARAVKSLNSKIDAIQMPTEQRCTTNGRPLMNQLPVDRNERPQVNQTPEVTRVSQTTVASLVNQAPAANGRHLMSKTPAANGKSVMRQTPAENGRHLVSQTPAANGKTLKRQTSVTNGISLMSQVPAANGKPVVIQIPAPKGRPMMRQKTAESGRTEMNEIPVASGRPHTNKIPIAEVHPAPLVCPAKQVATDPKPKVDEEKLKALPQKLTSSRSRVAPKQEEAANTKVISRAAATEKVVIFIDDSDDDNDVRASCVILRPSGSGSLGERECDLMKVGAEESQEIPRRARKRRRREMQATVGVACMPLPA

SEQ ID NO: 305 - protein, 602 aa, Zea mays
MFYSHQLLARKAPLGQIWMAATLHSKINRKRLDKLDIIKICEEILNPSVPMALRLSGILMGGVVIVYERKVKLLYTDVSRLLTEINEAWRIKPVTDPTVLPKGKTQAKYEAVTLPEINMVVEQPMFFSEPDGAKFRRMGLEDLDEQYVQVNLDDDDFSHADDRHQAKAVNITLVDNFESGLAETDLFNHFERFDIADDETTVNITPDEYPQVPSTLIPSPPRQEDIPQQEEPYYAAPSPVHGEPQQGGPEDQEEQKMKQPPKASKRKARWEVPRVIMDNNQMMIPGNIYQTWLKDASSLVSKRRKLNSNFNFIRSTKISDLMHIPPVALISHDNLFSELCYPKPLMQLWKDCTEVKSTKASSGGQRSSSQEPQPKNSPPQAGGEYEMETGGLPMDLTDGIEKLRANMSAKYDRAYNILHSDHSVTPGSPGLSRRSASSSGGSGSAFIQLDPEVQLPSGSGRSKRGQHSSARSLGNLDTVEEDFPLEQEVRDFKMRRLSDYVPTPDLLEETEPTQTPYERRSNPMDKITETIQSHLKLHFDTPGVPQSESLSHLAHGMTKARAARLFYQIAVLATCDYIKVTQLERKGDELYGDILISRGLKM

SEQ ID NO: 306 - protein, 496 aa, Zea mays
MRSGFNEDQKFSFRSSACKMIRTLVSLMRTLDPMPEERTILMKLLYYDDVTPEDYEPPFFKCCADNEAISIWNKNPLKMEVGNVNSKHLVLALKVKSVLDPCDDDNVNSEGDGMTVDNESDHDDDFSDTEVHPPKADHYIIAPNGKHVLSNVCICCFGIINRSFLTEGKDKDQDTGTISEDDTQDTAHEEELTSQVKEWICSRDSGTINVSDVLSNFPDISMELVEDIMDRLLKDGILSRASKDGYTVNQKADPKTPHIKKEAIMPDVSPTNVTKHNNGDLLYMKALYHALPMDYVTIAKLQGKLDGEASQNTVRKLIDKMVQDGYVKNSANRRLGKAVIHSESTNKRLLEIKKILEVNEGEKMAIDTNTEHPEPEHKDLLRVYEVGDGSTMGCLHSIGSDLTRTRELPELQQNVSMQSGQEASTVGKDSSRTPTSVRELAVPVCSLESGVLGKRIKRSLTGGNEMQSTQDKRSRKASMVKEAILQHVKCQNPQAQ

SEQ ID NO: 307 - protein, 211 aa, Zea mays
MSKKRGLSLEEKREQMLQIFYESQEFFLLKELEKMGPKKGVISQSVKDVVQSLVDDDLVLKDKIGTSVYFWSLPSCAGNQLRNTYNKLESDLSNSRKRYMDLVEHRDNLKRGREDSEEREAALEELKTVELHHKKLKEELAAYADSDPAAVEAMKDATDIAHSAANRQHFHFATMVFNHIPRSKRTTGTYVQGGMFLSCSVLTFLCLQYAA

SEQ ID NO: 308 - protein, 126 aa, Zea mays
MPIFALVDWNPAGLAILCTYKYGSISMGLESYRYACNVKWLGVRGGDLHLIPEDAFQELKPRDLQIAKSLMSSKFLQESHRAELALMVERGKRADIEALYSHGFDFLGKYIARKIRRAITSDDGMM

SEQ ID NO: 309 - protein, 265 aa, Zea mays
MPPRRANENFLEAYEVILILDDREKFGSRSRKVADNICSLSHFAVDVRQLPVGDGIWIARHKEDHTEYVLDFIVERKEVMDLDGSIEDNRYRDQKLRMKKCGLRKLIYLVEGDLNRAPKRVKTACFTTEILDGFDVQRTTGFADTQKRYVDLTRSVIAYYDASFSIVGKASPVCPTYDDFKRKCYDLKKKTVSDIFGCQLMQVPQVTEEAAQAVVELYPTPLLLAKAYSILGGDTSAQEKMLKKKNEMVNAGASRNIFHLIWGDG

SEQ ID NO: 310 - protein, 298 aa, Zea mays
MAAAGGGREATTSGCGLKRRYAPHDQEEETMNQDQPSKEDRCGRIWSGIDLLKDVTENKHVLPTGLEGIDRLLGGGLRQGQLTEVTGPSSSGKTQVCLHSASHAPVKHTGVVMYLDTSNSFSPSRIATIIDGTNDLSDQKGFDLLSKERLKTVMQSIICESVFDIFGMFEVLHQLEVSLLNEKVIGDGRRICLLIIDSISSLLAPIIGGKYPQGRSMMISLAMILKKLAYEHNLAVLVTNHMVSAGNGAVKPALGESWKSVPHVRLMISREHSSNICTGTVLKHTLLASGRTAKFVLP

SEQ ID NO: 311 - protein, 867 aa, Zea mays
MQKHSGLRSLEGFRSLVGSTSTAMKVANPRPSPDTGGISYGSFANLKITAEKLVKEQASVKTDLEMAHVKLRRATEQINIIEGKLQQALNENAKLKVKQTEDSKLWQGLDSKLSSTKTLCDQLTETLQQLASQTEQAEEDKKFFEEMLGKNSKALDEFNCLLRDLSTKLEYAEQKIISGRQEMLQIKQEKEEMDRSYKGQLYSNDTTIKEKDSLIKQLEGSLDDNKSRLIYLDSRLQCMEQELKLKDDVCISLKGNLASSESEKNSLELMNKGHILEIKKLCQDNKDLNELFSSFMVKVTELDKEHASMSSHVSRLISSFERFYEMAQEEKMLMARSSKDKFEHLQSQYVDLTSENNALKTEIEELKSRLIELQRTQEIVMVQHVEECQVAEDKIRRLESEAEVSASNINQLEKLASELQGRIQKLLEDSTFAENHKQELLQKILKLESDNQELLGQMQSIMEEKSNNAESLHGEITKRDQQVDTLENQINQLRSVLDEKEQLYLCSVQKEKTLEEQKLQVEALLSATECKLSDAKKQYDLMLEGEKIELSKHLKELSLKNDQAINEIRKKYELEKIEITNAEKEKAEKLIREIENKCNEKISQNKHDSQRYLICLKEEHGTTVARIQQDNEHKESTLRAYHKEELQRIQSQAENEMRERLSLLRKEHEVQIKSLRMHHEEECQRMQEELELQKSKEEKQRALLQLQWKVMGESQRVDQEVNSKKEYSVSSIRRSDPYGRKEQEVQLVSPETNRKDVNLPGILQSPISNMLRKVEKVSQDIPKHRKVTHHEYEVETANGRITKRRKTRSTVMFGEPNSQKPLHNTTDKDVKKLKKVPTRSRAHPANIGELFSEGSLNPYADDPYAFD

SEQ ID NO: 312 - protein, 678 aa, Zea mays
MRRRNLIVHSDSDEDDGEGMTTATTPASVSASVASGGVSGSGSVGRPSPQNLSPLPVPFPSLSLSSAPFVISDDDEDVDEIVDPDGDSPIVDAPEVFSPPAPPALHAPAPAPPSPPPPITTPSQTPIPTPPSARTPTPTPPSARTPTPTPPSARTPASIAPPHPSPLSGRLRPVDEFLRRLGLLLRPDWLESCAAGIPGFDGLGGVEAQARRCFEQFLFADMNSCGAGVLPEGVGGMHAEFLDGPFVLQVDEVVNISVPLKERYREAPAGPKRCLKLSMTDGIRHIFGMEYRPIKDLTVLAPAGLKIIVRNVHTRRGLLMLVPEAVEILGGVVDELEAARARLVSEVNKPPRGKSKQGGLSLSSRATRAAWPCSTDITNGVAQGISMQRAVNSSYPTGSGNAFQVGGATETVVEELVSPLVANRVQEINMQGSYASLTRETTETSMHTTHEYDPTHITEKSTGTVMEERPDPPILANSVHEQMQRVQPANGAQSSNVGKINQMEQSFILSGENEKPFTYIYSMLIDWGRQQDTKAYIQGKIKGLITSVKKFQYKQRTKYELYVYIDDGSFISEAFIDSDIVNNMLGLSPGEVTAALAGELEFASPSEVKETLKGFQKFLVKFEGMMLIELNKNSPVPVVRELNEGCSSSTAWLLLGRLKTISSQKKTIQTQDIMDTTP

SEQ ID NO: 313 - protein, 689 aa, Zea mays
MPSRRALRRSPPPRQSPQAAADAKEAASPWLPSSSSTSSSSSSASALVRRSAAFSAAGPRGGSGTRVYPLRDFPGGDAAALGGAFRDNVRWLLKQWSCVPGSVSAWRALLSDERTGALVPVIAVEELAASSPLPLCDLCRCAGWSHHWVSKRKYHFIIPAVVDWDQPFRADGLLGHSEHLLHGLIHSNGFGHLLTLRGRVGGSTFLSGCQIMDIWDQLCTALRVRAVSVVDLTQKYSVDLRLLLGVAQSKTWFTRWGYCLAKGCFSVSRSTYTAALEALAALPVDCLRSRHVRRVVTIYRRLSSKPLVTVREFLLCLLDWKHREPPLSPPPVKASSRLMFLLPKSCMMKRPRQPCQRFEDVVDLLECRWSKKRLLSAANVVVAKLREHADGTKITRQAVRDAARGGIGDTGLLDFVIKSLNNTVVGNHIVRRVPDPENRVLHFSLEEYAEPEPQPQADHELEPVELDAENTPPAVRWPNAAEAERDLRAVYRAMVGARSEAAQAVLDCKHWVKWWGLRDESDDQLRFLVEWRPQPWEATELTRPMPPGDIVVVPLHASIGELLVEAEHALRDTYCFFENFQAESLDGITGDKWDPVMLGGAESGDTIGVHGHGADMETGLRCQGGADAWEVQCVCGAQDDDGERMVACDACNVWHHTRCVGIADGAPVPPLFLCISCSGALMAAGPISG

SEQ ID NO: 314 - protein, 1126 aa, Zea mays
MAAADGDALIAAFAVSKGGIVLKHIFLNAPPPEAMCGSGGREVESDEEDPPVMVGRHPDCHVLVDHPSVSRFHLELRCRRRQSLITVTDLHSVHGTWVSGRRIPPNTPVDLATGDTLRLGASKREYKLLWLSLREAFEMDDLMYMPSLPEEDKEEPYVKEPSSKLLPGHRDSVNMETHQDTSEQIVSEDIAFPAKVAPSAPPLSEFLQPFFVEEHSLSQFHEKRNGVTEEKLVDKNQISESFGSLIIQEMPGTLTNAGKSIQSGEQEDASNKVSKRSKLKSVKSLRVDTGRSSERSSTLSHSFQKGDQNDIVVCSQSCGTECAVCIALFGISEIEKAEEKEELIAEDNVDMNPPASMIMEGNMNERKPDNYIPQDPIGAKLQKKLGLLDSALPLHFKDDVFADKEIPQWNVASVHTESELLSEYLIIPEVKHDDLNHLNLEEGLSKSENINPNKITEGPGNCQLEGTIRGNLFDNLDTDGIEEGEEICPLDKDEITPNGSGNIIMERSNIVLKPTISQQLMDSISPLNLDHGDFSENENSMLNTGDQMKLNEPVSENLNPLIPTDEKYLKSQTEECMPISYLEFKDDILLDRENSVLAPRKYEAMSPVRQENLFSDKENVTPASKVKTVVRGVLGTRMDNSVSAANASNKNKVLGSRVDNSVSTENSSNKKQCELSSKSKKVHTVDFDVFYSDKENLTPISSGGMKARKCFPKDLSVDLDQDQEAFCSDKENLTPLSSAARKTRDMSGNLTRVESAVTKKRVVGRLPFQTLVSNSPLRPASSHDCTCAVARPAGVAAGDLAIKLEDKLNDLSCNGHESGSAGEGMKTWTMVANTDSLLDDESRKAIMLLKGLKGTRLFIPRIVIRELDSMKQREGLFRRSTKATSILQWIEECMARESWWIHVQSSADMFPVAPTPPATPSAQRIDEEIEISSGSFNPMMALFGPRSSAALADMISPRPEDRVLDCALLVSRVRSNEKVVVLSNSVTLKIKAMAEVSTVTTQTQPCLLAVCVRTEPGCVALPAAQGLPCEGAKEFRESLVDPSSRRFMWAASAPRGSAWSCLDASALAENYYNSRHHAMKRRVLVAARPSESEAAKGLKLILRHNSLYAQATDAVNKTPLVSLAAV

SEQ ID NO: 315 - protein, 407 aa, Zea mays
MAGRDKRRRAAPLEGDEQQLRRRLEEAALLLRRIKGLVRWIVEEVAAGRSPSIVLHRYRNYCSSADSASPSPCACSYDIPVGTDVLSLLHKDYHTSRLSTNTSKSLHLCDHTNYFLMRCSCVDVLLRVLFVVQQLLQQNKHCSKRDIYYMYPSIFVEVAVVDRAINDICILFKCSRHNLNVVPVVKGLVMGWIRFMEGEKKVYCITSVNAAFSIPVDIEAIKDVVSVAHYILVVEKETVFQRLANDKFCERNRCIVITGRGYPDIPTRRFLRYLVELLHLPAYCLVDSDPYGFDILATYKFGSLQLAHDANLLRVPDIRWLGVFTSDFEEYCLPDCCLLRLSPEDRRKAEGILARCYLHREAPEWRSELEAMLQKGVKFEIEALSANSISFLSHEYIPQKIKQGMHL

SEQ ID NO: 316 - protein, 555 aa, Zea mays
MEGKAVAVGCGGARVDPADDLKYISGLSTILVATIQEVKDQVSQMEFIFCSQLFPHIQAKSKLVQAHLADTMKASEVEWRKTEAGLVKQLEEVSRGKMLAEERLLQLGTSLEEMKRKLVDSEQLAARHEAEKKQLLGRLEDETRKGEVVRQLQREIEEKDAEVVREREAHQRLLQEFEQLAARHESEKKQLLGRLEDEMGNGEVVRQLQREIEEKAAEVVREREAHQRLQQQVDLKDKNLLLEQSKRRDLIEDYTQLKTNYKHLKSQYTFLLGKIDQHEGSKPPEDIPADRRNTESPPSKRKFKDLEHTNKERIQILPNTRDLKNDSAPGAKAQAAQHASSVRSPIRNSHLAVPSRPMNPLANHSANNSKLQASTSVASPCLNWRETRARKEQGVADPHDDFLDTPLEAVKNTIRNPATPEEALALAASPQVMDFDNSDDETQDLNIATQALRHIPNMPVTKQQNTISVHPPKKDFKYRESVRKKADRENLKGVECKQCKKFYDAVLPGGRADGDGAGSTSLRCEHHDGVSRHRYRYAPPLTPEGFWNIGFESEM

SEQ ID NO: 317 - DNA, 21403 bp, Artificial Sequence
  RV036376
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgccccggggaattgggggtagaccggttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgtgatgcatccggacggggttttagagctagaaatagcaagttaaaataaggctagtccgttatcaacttgaaaaagtggcaccgagtcggtgctttttttttgcggccgcgaattctgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaaggggcttcggaggatgttttagagctagaaatagcaagttaaaataaggctagtccgttatcaacttgaaaaagtggcaccgagtcggtgctttttttttgaattccaccggtgttaacggcccgggttaacggcaaacgctaattagtcactaggcccaggaaacactaactaagccctagcttatcctagcgcaacctagttaggtcttccccaagtttgtacaaaaaagcaggctccggccagaatggcccggaccgaagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccgatctcccgggcacccagctttcttgtacaaagtggccgttaacggatcggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttcctagggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 318 - DNA, 1659 bp, Zea mays
tcagtgtaattcactattctagcgaagggaagatgttttttcgaaccttcggataaagacattcgtccacgtcgcagtctaaatttgttacaaagaaacaaatcaatactgcggggggctactgttgggggccttctacctctgaaggtcctaaaaaatgtgactgactatatgttttcagtatgacatggattgttgcaggaggcttcaacttcggaataaagatctctctcgtgacaagggtaaagatttaacccaaaggtgataaaaatggacgacgaagctatagccacagaacttcggcttgatatgatgacgaagaccaagtataattatgaccaaaaaaggacaaagactacttagtccttaatgttttgtgctatgattgtagatggatgacaaggacatatatgtaatttcactcgggctgtgtcccgtgcctataaataaatgaacagtaccaccgtactattcacgtgaaattgtaatcacactctcgcgacttcatcttctaagcaagccgaaggtatcaatgtaatattaacattgttaatattttcatgtgttttacgaaatgtatatatatatatatgaattgatgaaatgcagcaattatcttcgttcgtttatatttttattcatatattgatctgatgaaggtatgtcctccttaaccttcgtctaatgagtatttcacccttgcggagataacgattcggaagacgaaggtccgttataattgacaattgtgttgtcttgttcttaattcatagtattcgagaacaagtgaccaacaattagtaattgctatgaagtaccataatttgtatggagcacatccggtttttattgatgcatgacatattaagcaatcactccatatttcttttttataagtttgagttcatgtgacttattttagaaacttgagctcacaaactttctcttatttggtttatgtatggtggaattatgtcattttataatcactgttcgttcagtcagtcgttgtgaactcttttctaatcgctctcttcattgaatgtgttgtaccaatacattgtatatattggatggagtaaacaataacatcagttagccaaataaaaaaatattatacggagagcggaaacaattaataaaaaaccttgaatttttttttggatagtttacatgtgtattgttgtaagccgtcgcaacgcacggacaaccgactattttttatttacgtttcagtaactccgactttttttagccgtaaaaaagtatgacatcagcatacccataacgtccatcagggtgcattaaggaagccgattctctgctctcttgttatatcgtattcctatgcgctggacctggctgctgcatgcatgtgatggtgaggctgtgagcagtctgtgatcggtgtagagcgacacgcgcggaggatccgtaaatcccggatcattgcacatactaatcgcaactaaccatgcagatttataggcaactgacccggtaggtttatttgtaggtcattttttgtttaacaagataacgctggacgcttatatcatgcgacactgacctataaatacatactacgcctgcacacctaggcattactgtgcctttatcttcaacccaaaccatccattaccatattcctaagctatc

SEQ ID NO: 319 - DNA, 257 bp, Zea mays
gatggttcacacagcgggctgcgggcccatcaaacacaccagattctgcagtcccaattgaaataaacgcgaccctagaaaccgcgggaacaagcgggcggaaaatggcgaatgcgtcccccaaataccgtgaaaccaaattcgtccacgggggcccatccatggtggagttggcccaggacgggcccaacgacacagcctttcttctgcctccttgggccgtccacacacacacacacactctctctctctctctt

SEQ ID NO: 320 - DNA, 5208 bp, Zea mays
ggggaactagagattcgtccccttgctgatgtcacccagaatttgatccaccgggtggtttctttggacggttgcccggacttgagttggagatgcttgttgtgcttcttcctccttatcattttctccatgtgctctcccttgatccatgccttcatcttaaggtacatgttcctcatcttgagtcgggggatgcatcaatgttgaggaagatggttgatcttgatcttgttgttcctgcggtcgcacatcgtctattgccattgttcgcattgcgtccgttgaaacctcatcctcatatacatcatcaagataaacttgctctcttagagagccattagtctcatcaaatacaacgtcgctagagacttcaactaatcccgatgatttgttgaagaccccataagcctttgtatttgaaacataacctagtaaaaacccttctagagctttaggagcaaatttcgaatgtctacctttctttaccaagatgtagcatttgctcccaaatacacgaaagtatgaaacattgggtttgttaccagttaggagctcgtaagatgtcttcttgaggaggtgatgaagatagagccggtttatggcatggcaaaatgtatttacagcttccgaccaaaactgctcaggcgtcttgtattccccaagcattgttcttgccatgtcgatgagaatcctgttctccctctttactacaccattttgttgtggtgtgtagggagaaaagaactcatgtttgatgccttcctcctcaagacacttccacttgaagattcttgaacttagatccattgtcgctccttatcttcttcaccttgagctcaaactcattttgagctatccttaggaagcactttaaagtatcttgggtttctaatttatcctgcaaaaagaacacccaagtgaagtgaaaaaaatcatcaacaattaaaagaccatacttacttcccctgatgctaagataagcaacaggctcgaagagatccatgtggagtagttccagtggttttgatgtcgacatcacgttcttgctttgatgagtagttcccacttgctttcctgcctggcacgctacacaaggtctatctttctcaaaacagacatcggttagtcctaacacatgttctccctttataagcttatgaagattcttcattccaacatgtgctagacagcggtgccagagccaggccatattagacttggctattaaacatgcatctagatcgacattatttttagaaaaatcaactaaatagagcttgttgtctaatacacttttaaaagctaatgaaccatcacttattctaaagacatatacatcaatatttgtaaataaacaattgtatcccatatgacacaattgacttacaggaagtagattgtaaccgagcgattctactaagaacacattagaaattgaatgctcggtagtgatggctattttaccctaacctttaaccttgccatgattcccatctccaaagatgaacgtgtcttgggaatccttgttcttgacgtaggcggtgaacattttcttctcccctgtcatgtggtttgtgcatccgctatcaatgatctagcttgtgctcccagatgcataaacctgcatggtaatttaagcttgggttttaggtacctaactcttgttgaatcctacaaggttagtcacaaaagactttggaacccagatgcaagttttgtctctcttgcacttaggtcccaaatttctagcaactactttatcgttttttgcacataagaacaaatgaagcatcataagtttgataaagcatggttggtccatttgatgcattcctaggcgcatgagaagcaacatgatgaacatggcacctagttctatttctaccatgagcatacgaagagctagatgatgcaaacatggcatgagaattaaaaaccgcatcatgacgagtaggtaaaacaacatgattataacacctatcatgatgagcaacactagaatcattcttaacaccagcataaagatagtcatggttctttttgtcatgtgaagaatgagagctactagccataggagccttccttttctccttgttgagattggaggtcatttgacttgttaagttcttggttcccttttggaaaccaagtccatccttaatggaggggtgtctaccaatggtgtaggcatccctggcaaattttaacttttcataatcattcttgcaagttttaagttgagcattaaggtttgtaacatcattgttcaacttaagaatggtggaaatatgaatattgcaagcatcaatataaaaaactttacatctattacaaatagacacatgttccacagttgaactagccacatttaccttttctagcttagcatttaaatcaacatttaaactcttaagactagaaatagaatcgtgacaagaagatagctcagaaggcaataattcattttcttagtttctagagcaagagattttcaaacattaataaatttatcatgttcctcataaagaacatctttttttctaacaacctatctttcttattaagggcatcaattaattcattgattttatctaccttagatctatctaaacccttaaagagatcactataatctacatcatcatcagattcctcatcactagaagaagtatacttgggggtatctcgtgtacgtaccttcttctctttagccatgaggcacatgtgatgttcgttggggaagagggaggatttgtcgaaggcggaggcagctagtcctttatcgtcggagtcggatgaagagcagtccgagtcccattccttgcctatgtgtgcctcgcccttcgccttactgcagttcttcttcttcttcttccatttcttttcttgtccctagtcattttcattatcgagacattgcacaataaaatgtccgaacttaccgcatttgaagcaggagcgctttccccttgacatgttcttatttgggtattccgcgtcccttcaatgcagtctttaaacgcttgattctgatcccctttcccttataatccatctctttgggcggttagtcccttgatgaagagaacaattctgataccaattgagagcatctagaggggggtgaataagtgatcttgtaaaaatcaagactaaacaacacaaacttggtttataaatgttagtgaagtcaaaaccaaggtgctatgaatagagagggagagaactgttcacttgattattcctttagaaggtgtattgaacttaggaacaatagtgcaagtgattaagtgaaaactctaaggaagaaagcaatcacactagaaagatgtgcaagtgacacgttgttggtgacctccttcggtcaaggattgcactcaatccctctcaagtgatccaaagatcaaacttgagtaccacgattttcttccttttctcaagaattccctttgtgagaaatctccacaagttggagcctctcacccttacaagattgatcacaattaaaccacaagagtaagggagggaacagaaacacacacaagtgctagagtcgcagcaatgacatgcacacaagtcaagaaacgagcacacaacacagcgcaacgaggtcacagttcaaacaagtgctcaaatcttaaacacaatgaatcgaatgcgtgcttgcggagtctagacgttttttcaatggaggcttggtgtactgctccatgtgtctaggggtcccttttatagccccaaggcagctaggagccgttggagctccatttggaaggccattgttgccttctatccgtgggtgcaccggacagtacgcgctcgggacgcggcacataatcccatgattggccggtttccgcttctgggggcaccagacggtccagacgaccagtgcgcctgtcgaccgttggccagcgctgacgtggccactagtcgttgcgtggctgatacaacagactgttcggcgcattgcgcggaccatccggtgaattatagctgatgtaggctaaaaaacccgagagcagcgagttcggccgaaccgtgcaccagactgtatggtgggtggcatcagaccgttcggtgctacacagtctagcaactttttcctgtttcttcttttgtcttctttgtttcttttggacttcacttagctgggtcccctggcacttagacaaatatgattaacactcaaatcaattgacttagtgtctagagcataccttttagcttgatccatatagctttgtactaagtcctcttccgagctcattttgcctcacacttttgcttaacatcatgttagttcaaacatcatgtgttgtgcatctaatcaccaaaccaatatagaaatgcccaaggacacatttccctttcagtcggggggaggggggttggtggtcgacgccccggtacgaagtgggtgggggcaggcgagagggggtgcaccatgggccacccagtgcgtggtccgggttttgatccatgtaactctatataaatctctatttaattcggtataaaatagttaagatgaaagagagaataaaatttagtagatttgacagtcatataaaatttctagatcgacccctgtggtgggtgcgtcgaaatttctagacccgcccctaggccggggatgacacatggaaccgtgtatgcacaaagctgctgcattataattgtagagattaattatgttatttaggaaataaaagtttaggaatagtatataaaacaaggattgagctccagtatatataataggccgagtcctgtaattttgtgacatttttttgaaaccaggattgagctgcagtttttagtgttagagtccagcgtctcacaggagtggtccaattcaaattcgaaaatgtatcaccgctgaagcgaaaaatatcataaattcataacgaaccaaccgaccgttgcacggacgagaactcgacgagaccgaaccgtgaaaacaaccgaaagcacaggggctcaaacgaaacaatcccgcccacacttccttcgccggctcatggtggccactggccaggctgtcatcctgttctataaagcgagccgaggggaagagccggaaccctagcccagcaccgcagaggcgcagagacaggcgtcttcgtactcgcctatctccgcgactcaaagcttcttccatttcctaccgccgccgctgcagctccaccccattccgtcgacacc

SEQ ID NO: 321 - DNA, 10000 bp, Zea mays
caaaaatttcattcctgcattaatgcatttttgttaaaactaggtgaagtgattttattgtcaaagagcttaaagcttaaccttgtaacaaggataagctacctttgtttcaaaggtggagggtccttaagtctctttgaaatccttaaggataaatgcttcaaatgattccaacatgctttcataagtgcatagtctgtcgtgagcatcacaattttattatgacacattgcatttcacagtttctatgataaagatatgttctcattaacctaattatatagaactgtttaagcttcattgacatatccttttaatcatgtctctttcctttggtacatttgcatatttcctatctctattgtgccaaggctaagactaatatgttttcatgagtatctcgtgtattaagtcttagattgaaagggaaatagagtattcggcaaagacatcgcttccactctatccttccttgccggtattccgtcagctctccaatttggtataatcttcactcatatattggttgccaaagggggagagaaaataaaaagggcttatatttcattcacaagtatccattttttggcgatttatgccaaagggagagaaagtattagcccaaagcaaaaggaccgcaccaccaccaatttcaaaaaaaaatgtgttcttccaatttgtattaaaagaaagtttttcaattggtatcttgcttttgatagaattttcaaattggtataactattaaaagaaagtttttcaattggtatcttgcttttgataaaattttcaaattggtataacctctttcaaaattaatatccaaaaccctcttgaacactaagaggagaatttcattgagggggagttttgtttagccaaaggaaaagcatttgaaacaaaaaatttcaaatcttgaaaatgcttctcaaaatcttattcatttacctttgactattttcaaaaagactttgaaaagaatttccaaaagaatttgcaaaacaaaactcgtggtgcaagtgtggtccaaaattttaaataagaagaaaatcatctgtgcatatcttatgtaatgtatattggtttaattccaagcaacctttgcacttaccttatacaaactagttcaattatgcatttatatatttgctttggtttgtgttggcatcaatcaccaaaaagggggagattgaaagggaaatagggtcaaacctttcctaaatgattttggtggttgaattgcccaacacaaataattggactaattagtttgctctagatcatacattctacaggtgccaaaggttcaacacaaaccaataaaaagaacaagttaggcttcaaaagaaaggagcaaaaaggaaaccgaagtgttccctagtctggagcaccggactgtccggtgtgccagggtgaatcagctcaaactcctcaacttcgggtttcccaggcgcagctccgctataattcaccggactattcggtgtgccatcggtctgtccggtgcaccaggagagcaacggttatctgcgcgcaacggtgactctgacattgaacagtacagaacagtgaacgcggcagaagtcagagcagcaggttagaggggcaccggactgtccggtgtgacaccggactgtccggtgtgacatgaggatagagcctccaacgttcgaccagctacaagccctaacgacagaatgacgtggtggcgcaccggactgtccgatgcgcccattgccagcagccttctccaacggctataatttggttggtggctataaataccaccccaaccggtcacttcaaggtgtgggagcccaagcaacattccaagtcatatagttgacatattcaaaccctcccaaccacctctattcattgatccatcctatacacaagatttagaccactacaaaccacacaagtgccacaaaagaaagagcaagcaaaagagagcctcttgtgagagtttagctctagtgccttgtgagattcattgagagaaagtgtgtgctacatcttgcgttcatttgtgcgtggagttttgactcccattgaacttcctccaaagttttggaggcttgtaaagctagcaagagacacctaagtgtgtggtgatccttgcggggtcttaagtgatccttgagaagaagaagagttcgccgatctttgggatcggtggagagagggaaagggttgaaagagacccatccttagtggactcctcaacggggactaggccttcgagggccgaacctcgataaaacaaatcacccgtgtctcgtgtgtttattgcttgtgatttgtttgttctctccctttctaagttctcttgcgctactctctgctaacattattttgtgtttgaaagtcgcctagaggggggtgaatagggtgaatctaaaatttacaaacttaatcacaactacaagccgggttagcgttagaaatgtaaacgagttcgagtgagggcgtgaaaacaaatcgcaagcgaataaagagtgagacacaaggatttgttttaccgaggtttggttttcgcaaacctactccccgttgaggtggtcacaaagaccgggtttctttcaaccctttccctctctcaaacggtccctcggaccgagtgagcttctcttctcaatcaattgggaaccaaacttcctgcaaggaccaccacacaattggtgtctcttgccttgattacaattgagatgatcgcaagaaagaatgagaaaaagaagcaatccaagcgcaagagctcaaatgaacacaacaaatctctctcactaatcactaaagctttgtgtggagttgggagaggatttgatctctttggtgtgtcttgtattgaatgctagctcttgtaatgtagttggaaggtggaaaacttggatgccaatgaatgtggggtggttggggtatttatagccccaaccaccacaaagtggtcgttggaaggctgcaatcgcatggcgcaccggacagtccggtgcgccaccggacactgtccggtgcgccagccacgtcaacagaccgttggggttcgaccgttggagctctgtcttctgggcccgcctggctgtccggtggtgcaccggacagtccctgtaggctgtccggtgtgccacccgcgcgtgctctgctcctctgcgcgtgcaggcgcgcatttaatgtgttgtagtcgaccgttgcgcgcgaagtagttgttgctccgctgtcacaccggacagtccggtgtgcaccggacagtccggtgaattttagcggagcggatttccgaagctggcgagttcagagtcgctctcccttggggcactggacactgtccggtggtgcaccggacagtccgatgaattatagcggagcgcctctgagaattcccgaaggtgaggagtttagcttggagtcccctggtgcaccggacactgtccggtggtgcaccggacagtccggtgcgccagaccagggcacacttcggttatcccttgctctcttgtttgaacccttttcttggtctttttattggcttattgtgaacctttggcacctgtagaacttatagactagagcaaactagttagtccaattatttgtgttgggcaattcaaccaccaaaatcaattaggaaataggtgtaagcctaattccctttcagtgttgcttcaagttaaattcttatttagagaagcaactccttgcaagaaagaacttgtgtttattttcttcttaactaagccctcttgcattattctccactaacatttctaatagtattgttattgattaaactccgcactccttgaaaacaatactcattgcaagcaaaggtttaagttttatactccgataattgtggatcttgttctaaccactaatcaagggatctagtttgtatttagagctataattttcaggtttcgcctatccacccccctctaggcaactttcagtatctattaaaaccctcttgaaatctaagaggagaatttcattcaaggggagttttgtttagtcaaaggaaaaacatttgaaacagggggagaaatttcaaatcttgaaaatgcttcttgcaattttattcatatacctttgactatttgcaaaaaaaactttcaaaagattttccaaaagaatttgcaaaaacaaaacaagtggtgcaagcgtggtccaaaatgttaaataaaagaaagcaatgcatgcatatctagtggaattataaattggtttaattctaagtaacctatgcacttaccttatgcaaactagttcaattctgcacttatatatttgttttggtttgtgttggcatcaatcaccaaaaagggggagattgaaagggaaatagggtgtaaccttttcctataaataattttggtggttgaatgcccaacacaaatgttggactaattagtttgctctagattatatgttctataggtgcataaaggttcaacacaaaccaataaaagattgaagaaagggttcaaaaataaaggagtaaagaaaccaagagtgccctagtctggcgcaccggactgtccggtgtgccaccagactgtccggtgtgccaccggactgtgtccgtgcaccaggaccgtacaacgtccaactccttactctcgggtttctcagggcacgctccgctataattcaccggactgtccggtgcaccggcggagcaatgactccttcgcgcaatggtcgactgcaaaagctgaagattcggaggaacagtgatgaacagtacgcgcagagtcagagccgcccgttagaggcgcaccagacactaaacagtgcctgtccggtgcggcaccggactgtccggtgccactagaagacaaagcctccaacggtcgacagcgcccgaaccctaacagttgggcgacgtagctggcgcaccggactgtccggtgcgcccatcaacagcagccatccccaacggctatgtggtggttgagggctataaataccccccaaccaccaccactccaagcatccaagatttttgaacatcacattcaatacaagggctctagcattcactcctagacacaattcaaaagatcaaagcctctccaagtcccaaattcaactcaagcacttagtgacttgtgagagagagattttgtgttcctttgagctcttgcctcttggattgccttcttcctttctcatttcttttctcaaagtgatttttactcgaagcaagagacacctaagtgtgcggtggtccttgcggggtctaagtgacccaggagattaaggaaaaggctcactcggtctaagtgaccatttgagagagggaaatggttgaaagagacccggcctttgtgaccacctcaacgaggtctaggttctttagaaccgaacctcggtaaaacaaatcatcatgttcatctgccttatttcttggttgatttgttttcccctctcttttggactcaaattcatttctaacgctaaccccggcttgtagtgtgtgcttaagtttataaatttcagattccgcctattcaccccccccccccctctaggcgactttcagatatgggctgaggcaggtaagaatgggcccagatgctggtttccccttttgtttttattcttttctgttttcttttattcctaattcatttgaatttatttttttgaattcaacttaagtgtaaattcaagttcatgttaactatgcaatttggtcacaccaacatgtggtgaagttatttaattataacattattttatattgaataatatttctctccttccttccctattttcaattcctttcatattttgtatttctattttgaattaaatgtatacagagttcaaacttagatccaatgtacaatctcaaatattggtacaaacaattttatatttacttatacatccatatcctttatttttgtgtggtttttccttctctttctcaaattctaggatttcttttagaccttaaaattctactttggactttaataaattttctttttacattacaaaattccaattccaatataggatatagtttaagaattcaaacttaatacatactcacaatcaattatggagcaatagatacatatttattttaattgatttatttgcttgataaatgtttgaaatatggcacacactcatattgttcctttctttttaggagaatagtattttgattgtgggacaagagtcaaaagttagtttaaaattaaatattcttgtaaataaatgcttatggtgcatcctttaatgaaatgcataatcattttgttgaattgaaaacctttctactacttcttttctaatataattattggttttcaaatttcagtcctcaattttcaatactcaaatataatttgtgaaatctgaattttccattttatttcttcatatattttattatttttataccaattttgggccttacagaaaataaagaaaataatgtagaaaccaaggtgtaggaaacagtgtcacttaagagggagtggattaggcttctacaaactccactctaaactaggccacaaataaatctctagaacaaaacctattcaacaaatgtaaactaaattgtgcaaactatgttttgactgagtgttgatatctctaccgcaaaagaagttttacaacctaagttccaattattaaagaagagattaaaacttaagtacttagtgtaaatgcggaaggtaaagagcaaaggtagagatgcaaactcccgttgacgataccagtaattttatcgatgtatccgaaaccacgcaaggttctcactaatcctcgttgatgcccctacgcatagggtagcccacgcgaggaccaaacaccacggacgatatcatgtcgtcctaaatgccatgtatttaaaaatggagggagtatccaactcccaaattcgaatatatgctcatttgggttattatgtggttttgaaggaagccatggatataaataaaaaggtcatcttcaggtgagtggattcatctcttcaatccacaccaaatatgttctcacctcttgtacatttttaacaacaaatgtgttgttttgtcccatgacatgaacaaggtcttcatatgtttctagtaagcggatgcgggaggtcgcatgtccaatctacatggtccatcttcaggtgtctattttttcgtagcaatacacctcttctgaattatgttacaatctaagggtagactgcaaaaaaccatgcagccatgtacattgccatcaacaaaaatctataacagagacatttttatactatgatcaatatacatttatatctacaacaatacttgttcaaaaatctgtaaacaggtaaaaaccacaatcctatgtaacttagaaagtcatgattaaggtgatcactgaaacaacccggtttctatgtccaccaggattgatgaaataggggcgtccattgtctatgtgtcgcatgcacagtgtctccctccctcacaatggttcatgctccccaacctactccactaccttcgatctccaagcacaacgaccctatcgctatgcatgcccaaccactccacagtctcatgattccacccacaactgggccagggacctccttgtaaccctaccatatctttatagatgaaggccaccaagatccctcctccggctcataaaaaacagaggacttactggtgactggtgacacgcacgagtagaccagtggcgaagctttggcgtccgcacgcgtggggcggagacagaggaagagtggatgggggtcgcgtccctcgtgggcatgacgcggggatgggcagacgcatggggagacggtgtctatcgcagtggatctcgagcgagcaggcagagacgaagatagaggaagagtggatgaggatcacgtccctcgcaggcatgacacggggataggcaggcgcacggggagacagtgtctgttgcagtggatctcgagcgagtggatgactgtcttcgggggaaaggaggcacggatgacgggggcgtgcgcaggcattgtggccatgacgttggaatcgtggggacggggcgcacgggtgggggcaggcgaagccatgggtgtggataccttcgttgtactcttaaaatttcgtagatatcaacattataaattcgaatttattattgttctcttcaacaaccaactccagaattgaggaaccaagttataaccattgtggaaaatcatgactttgtaggattcagaccttcggaatagaccttcgggggcaaggggctaccgttgaggatttcaccacaggtaaacgtgtctctctcgaaaattcatagttaactaacgtgcatatgttgtcaacataggtttgcataattgactttgtgaccattaaggcaatcaaaagtaagaggaacatactaactcgcggacacgaagactccaacctctgcccccgaagctctggtagcgaaggcaaaggggcacgaagcctcacgtatgaaggctacacacgtgaagcctcacctatgtgaatcacgtgcaaggaagcttcaatgaagggaagtaccctaggccatctccagcgggtcatgtaaacggccgtacaaagtactgtttagattgtattgtttgcagagcagaatttgaactaaggagtgaaatagggagtgaaatagagagtctacggagaatacctcgtttgaggcacagacatgctcacgatgaccaaccgtccatagtggcctggttggatgagagatggatagtgatcatatcaccatcgtgcagacgaattgttataatcttatagttgggaggtcggagtcttttttatatatggattacaaagatatagggatccctataaacaccctcagtatatactgtttattagggacatggcaaattttatccaatacattacagggtatattcgcattctcccccatgtactgtaatgtactgtttgggtccgttcgataaaaaaaaatagatggggtggtgggaaaattaatgtctctagctctaatcatcttacgtctgcacgcgtcttgtttggataaaatttgtatgttcatcagtttgcatgcacctggtttgggtttgggtggaggcatgaacataaaaactacccaccctagatctcgatgcaatgcagcataccgaaccagacgcaggaggaggcgccgatgatgacgatggacgtgcactttgcttgctccggactcaaacgaagacagcgcgcagctcacctcagatctccccaccgacacacacacacacacaccaccaccaccaccagtttggaactttgcatgcatccatgcatgagcgagtagcacggatctacctccaacgtacagcagggactgctatctcgtagccgtagagcagttcagggtgcagaccggatccgttcggttatttgtacatcgtccattctttttttacttatagtcttttaatttaaaaataaattagcaacgataaatattcgaaaaccgagttatttctatttctacaggggtaggggggagaaacaaatacgcgtccgtgaataaaagatcaaaaggaatcgatctaccaggcttattttacggggaaattacgaggctatcgatagttagttacaggataagggggattggcgcccgaaatcttcgcctaccgaccgctggaccccgcgccaccgcacgccctgaccaaccaggcgggtccacagggcagagaccaaccaggcgggcccacagggcaaagggagagaaaataaaaagaaaatatatacgtaccagaaatttatctattttacgggcggataaagacgggcggtaaatcctagtcccatccaatcccgtcacgttcggcgaaacccgggttataaaaccggagcacctcgccccccctctaccaccaccgcagccgcagcacaatcgcctcgccttcccttccccaccagcccgtctctctcttctctctgactctctctctcgtagccgcgtccacctcgcagcagcaagcaagcgcgaccaa

SEQ ID NO: 322 - DNA, 943 bp, Zea mays
tttgtatcatcattcatgtttatactgacacatttcggataaggtatgtgcagtgcaacagacagtttgctgggtacctttttctgaatacattagttgttgtgtaccaatgactctgatcagtcgcgcattgttttacatctgtgctgctgttgtctacggccatatcatctggacatagcacatgtatcttgtatttgagccactggcatgaacacagtcgagtgcactaaaggactagacatactatcatggtatcccaagcacgctcttttatccaagtttcagagtgtctgatcgcgtcaatcattgatacaatcaggctatgacctagctcgggggctggcggtggtggccttgcttcagatttgggtgcgcaacagttcatgtgtaactttgcggttaggtttctctgggacaagcataaagtctaggcttctggtatgatgttgtttctggctgcttctacttgaccacttcactgctggctatagttgcagttgatctgctgaagtaacgtcatttttttaggctcgggttcctttgtaagttgctactgtacatactctcctggggcagctacttcttgatatatcattgtacttttggctacctaccccaaatctttgcaaggttgatctatttagtagtatttggtttcgaaatatggtgggatgaagccgatttgcttataatttgttattgtttggatcagttttacgtaggatagagtgactttgaaaaagaaaacaattatgctcaatactgacgcaaccgctctctagtatggagacgtttcatttggctttggaaccaagcactaactaaaaaatcgacatgcaagagcacaatgccttaagctctggtaaaaatcctcttagatctcgatttatcgtgcgctattcctggacacacaaatatatgccgatcaaagaaaactaca

SEQ ID NO: 323 - DNA, 1739 bp, Zea mays
ccttttgaaagagactgtcactatgtttccaagttactatagaataataatgggtcatttggaaacatgccactcaaatttttgaaaaattggaaactagttcattttcatgccactacatagcatcaaaatgaactagccgtctaattttgtaaaagttgagtgtcgtgtatacaattaatcctatagcctgtttggattagagatgacaatgggacccgatccccgattccccacggggaattcctccattaggggatgaggatggggacgaaacttcccccacggggatataaacatggaaaaatatatcccccgacggataaatggggatggggacggggaatcattccccgtgggtaccgttaaacttgcacgtgactatgtttttgtgtacaagttaatgacaaaaataaataattaccttatcaaaataacactaattgtacaaatatgttcattttgatgtatgtataatgatttcttatatctgacagattgacaatgtgtataagtgacaatgtttaacattaataacaaaaaacgtaggtcttaattataatttaaatggggatgggatcctcgttggggatttatccccgcggggaacggggatggggaagaaatgttccctcgcaaacattcgtgggggatcccccgcggggaaattttttcgtcgcggggacgaggatgggggagctattctccggcgaggaattccccgttgccatccctagtttggatgttgatatagaacatataattgggaattagaatcaactttcctaaattctattgtttggttgcacacggaattgatatttggaatcggagacccaatttcctagaattagactataactagaaacttcatctcccaatacagagcgttacccctctgtattgcgtggaattagaccgcacaatttcagacttcaattcaacgacattcaaacaatagaattggaattacatctcatttcaataccctatctaatttgatattaaacccaattcagttacatgccctccaacaccgacatcaaagtcatcataaaccattgttgcccacacaggcccgcagcaacgtgcagcgttatatatttatacaaaccatgtgcatacctcacagcaacgtgtagtgtctggtccagagaaattgagaacgccgaaacagaatcaggggcacagtaattactcccccagacccccaatcagtgacctcctaatcacaaaacactaacggaaaggagacagtaagattggcggagtcagaggtaccgttcgcctgaccttagtggcgacgccgagatcctccgacgccatcgtcctgccccgctctctccctgcctcctccctcggagaataccatcagcaatcagtccactccgggctccaaatccaccgcaacccctggatccagtggcccgagcgccgggcgcaggacgacgacgactcccttctcctctctctacgtcctccgaggcgagagagtcgggcgaaaatgacggggggccgcgcgaggcggctcggtgatggggtgggaggcgggcgagcggctcggcgcgggaatttagcatcgatcggggtcggggcagagaaagctggagcgggactgcgggagtggaggagaaccccgggtcgggaggccacctactactccgctcgtctgttgctcggggaggcggacggcctgcgacgcgttccgttccgttgccgtttgtcctttcgtgacgccc

SEQ ID NO: 324 - DNA, 10000 bp, Zea mays
ggcgccaggggcttcggaggaagatttggcgatcaaccaagaagaatcttttgcttattctgtggtgagaacaaaggccatactaccaggatgtgccatgttactatacagaagcaaaaggaaatagctgaagcagcagcacaacaagcccagccgaagcaggtcatgcatacagcttcgtatcattcgccctacatcccagaatatgtgggcaatcatcctgtagtctctgctgcttcggcaagtcagccttcagcttcctggcaacagcctccgcctccacctccgttgcaacaaggtcagcagccagaagggagccaatatgctccacatcaaagggacttcagagaacagtccgaagctcgcacggtcaacagcactgtgccagaatcaaagcacatctattgacaaatatcctaccttaatagcaatctttttcattcagttttattctctgtaataaaggacattgttttcatgtaattagtttcgttgattcctacaagaaaaatatgttttcttcacaggtttgcgacaataaaaaggaccttcggactatcgaaaatcctttgaagcaacgaaaagtcgttctaagaaacgcagagtaagtctgacgaagtcacaaaaagtcgttccgaagggagcgcagcgtaagttttctgctccaaagtcgttccaaaaggaatgcagagcatacagcgaaaagtcaacgctgataccgcctaagtaaaaggcgaagaagctccaaagacgttcctaagggaatgcagagcttataccgcctaagtaaaaggcgaagaagctccaaagacgttcctaagggaatgcagagcttataccgcctaagtaagaggcgaagaagctccaaagacgttcctaagggaatgcagagcttacagcgaagaatcagtgctgatacaaaaatattgtgtggggatatgtgtgtatctttcggaacaaatgtcatctacgtagcataacatcattacatcattttgcatagcataagcatcatacatcatgttgcatatggcccaagaaggggacacgatattgatcttcggaagtatgatttgaaagagtgaaaatcgtggtcccaagaaggggacacaatattgattttcgaaagtatgatttgaaagagtgaaaatcatggtcgtaaagagaatcaatcttcatcttcggaagtatagcttcggagaattttttcacgaagtttggatattcttcacgaagcatgaaaagaagggaaggtgtttttttcgccaaactcaaaaacggtacgtgtgtaaagtttcatgcatcgtaaagaattgagtagcaaaaatagatatattacattcggggttacaaaaatgttacattatattacatttccgaagttttttacaaaaatgtttaatcctctctcaaaacgactcctgcagcttcattcagaagccgattgacgacttcgtccataatatcttcggccatctttttaatttcgtcgtcccccttcggctgagggcccgaaggcgctttagtcggatctgaagcaggacacgactacattactattacaaatcgcaaacaaatcttaaaagcctaaagattacaacacggtagaagctattatttagtacctaattgaccttcgggctctgtgctcttttcagcagccttagccacttctctagcatcatggatgcccttttcacttctctgaataatttctcttgccatttctcggccaccgttgtcccagatgtcggtgaaaaattttcccccaaccgcgctagcttcggctgaaggatcttttatatcttcagtcgacaaggtggcttcggactgtgctaaaattttcacatgttcacagcccttcttctctaaaatagtggcaatccctctggcgccagagaaggcacatatatctcctcggctatttaaaatttcttcgaaggcttcagcttcgtggtcaatccattcaatgacactttcgggattgccccttagaaaattttcttcacttgagaatgcgccgaccttggcgaagctagcctttaattttttaacacagtctatagatttattgtagcatctctttttggatgaacgaagctcttcaacagtcacttctaggtgatctgcccattgatcgctgagttcacgctttgtttcttcaagtatacgttcctctgtggctctggccagttgtttccgaaggtcttcaatttcgcgtttctgagcttcagcctgacttttgaaagcagcttcgtcctcctttattttatctatcaatgagtataatattttgtctttttcgagaccttcgttcctcagttcaattacttcggaacgaaggttgctcagggctatagtacacccttcgtcttcagtatctttctgggctctgagagcattgctaagaatcaagccctgcaaaaaggaatatgtgtgtgtgtcagagggtttatatgaacggaaaaatacaaggatttcatttatcatacctttaaactgttataagctaggctgtcagccagatcgttttttgatagcaccgaaagcccgtcttctaaagttgggaatccgaagcttctgcttatctcccgacagacagaaatttccttgttgtcgggaagacagtacaagaagtcttcttctccactgccattaaatattaatgctcccttcggatatttcagtttttgggcataatgctgggcctcttgttcttctttttctgataattttctccccgaagcatgacgaaaaatataatcacgagtcttgggggatgcttcgggggcaacaacactagattcttcaatagttggctttgttattttctctgtctcactttccaaagtttttgcgggctctgagggtccagcttcggctgaaatctcttgctctggagctgtagaaccagagatttcagctgttgtttcaggagtaacagcagctttcttcggaggtgtgctcgaagatttgatcgtttccaatacgtctagcacattagccattctttttctcttcggagttgcagctggcactttttcattttttgctgtcccaatgattgctgtaggactcaaaacttctgatgttttggagccctcagttgcttctcttacctcctcaattttttctgtgagcggcgcttcggttttctcttttgtttctggcaacaaaatatttgagtgttctgattccatctttggtggcatttcggccgtttctgcgatctctggcaacaaggctggctcgattagtttttcagcttcggtggctgaagaagttttcccggtaaactccggcaccgaagctggttcaatataacgcggccggtgcgtaagaacctttatctttttccttttcagttctggctcgctaggagcagctgcagcttcttcttttgcagagattgtgttttttctcttctgccttcgaatgggatagcaataatcagggtagaagaacccgattgcatcaaacactcggttcagtctcttcttttttcggcctccgaaggctgctgatagtgcagtattttcagccttcgagaatgccccaagtaattcatcacttaatgtttcaatgcttttcagccagtcatcatcaggttcaataaatttatctgcatatttgaatgtgtattttaatctgactagtccgccttcgtcggactctttgatggtttctttcggcatttcccacttttctgcaagtggccataccctgaaggcaatgtgctcctggaccaagtcccttgacccaatgaaggagcagactgcgccgaaggctctttggcattcttcggctgcctcatccatttcaaccttcggccttcgaagcccgaagcgttgccaaattgggtacataatgatacttttgacattattttgcgctgttagatcatttttcacataaaaccattcagacatccaggctccgggccacctcttccgaaaggttggcacagggtagcttgacccggagcgggcgccgaagctgtagcacccaaagttgttgtggtattgctcctttccccagggcttcgtctcgtacaataactcgtgtatgttgcagaagcttttagcgtttggctccaaaccttggcttctcacagcccagacaaaaatccccattcttataatagcttcgggagtgagttgatgaaggtagatttggaatgttttcagtacctcaacaacaaaattgctcagggggaatcgaagcccagccttgaggaggcttcggaaaatcacaacttcatcttcttcaggggtgggagaagtcttttccccggcatcagctctcacaatagatatgtctcggaagtatcgccccctcatattatcaatgtgactctgcttgatggttgttttcccaaaaactgagtgacttggtcgccacggtcgatcttcggcctcttccccatcactttccacatcatagctgtcgctgtcatcagtatcttcggacaaaccttcaagaatctccttcgtgattttctctgtattagtctctgccatcgctatcaggaaccccagattcttctcctcctcgagactcagcttcgtctcagcagggatcttcttgtcttcagacatcttcggaaacactaaaaatttgttcccgaggccgaagcttcgaaatcaaaaagaccagcaaatctcaatgagcaagagctaaaaatttttagtgggccgaagcaaaaggcaagcgtgtgtaccaaatgaattcacgatgtgttcttatttatacgcctagggcgttgaaagttaaaaggccccgcttgtcagtgaatgttgctattctagcaaagggaaggtgttttttcggaccttcggctcaaggccttcgtccatatcgcaatctgaatttattatttacaaattaatattgcgaggggctactgttgggggccttcgtcctccgaaggtcctcaaaaacatgatttgacaatgttttccaagtgaattatatgaacaggtattttcggattcagaattatggatatggagcacgaccaggacgaaggctgagccagacgaaggtcgggggcagccgaagctgtacgcagggaagcttcggcgcgatggcacaagggggaaccgaccttaagatgaaaagacttcggggtcctcaatagatttccataaaccgttaacaaatgtaatggacatggatgtaattttacgtgggctgcgtcccgcgtctataaatagatgaacagtactcccgtactgttcacgctgactttacatttgcttttgcgtcacgcctgtactttttaccttctctcaggaccgaaggtacatttgtaatttgaaatcatttctattttctcatgttaataaaatagaaatgattccatgatgatgcttatattatatctcatgctttatatgagtctttcgttattacctattatatttacgaaggtatgtctcttatgaccttcgtccgaaactcattatttcccgaagggacataatgcttcgaaggacgaaggactttaacacttaacacttttcatgttgccttgttcttaactcttagcatttgagaacaagtcaccaacaaaccttaacatgctttttgttcttcttaataaggaagtcctcttggctatccaagagttcatccttctcatgaatagaacctatcaattcatttaatttttccttttgttgcatgtttaggttggcaaaaagggcaagcaaattatcttcatcatcactagagttttcctcatcactagatgttgcatatttagtggaggctctagattttaccttctttttgtcgtcctttgccatgaggcacttgtggccgacgttggggaagaggagacccttgttgacggtgatgtttgcggcgtcctcgtcggaggaggagtcggtggagctctcatcgaagtcccactctgggcaaacatgggtatcgccgcccttcttcttgtagtatctcttcttttctcttctctttcccttcttgtcgtctcccctgtcactatcactagataatggacatttagcaatgaaatgaccgggcttaccacacttgtagcaaactttcttggagtggggcttgtagtccttccccctcctttgcttgaggatttggcggaaatttttgatgatgagcgccatctcctcattgtcgagtttggaggcatcgatggggagcctacttgatgtagactcttctttcttctcctccgttgctttgaaggcaacgagttgcacctcggttgtggaggtggcgcctcactcgatgattagtttggagcctttgatcatcaattcaaagctcacaaactttcctataacttcctcgggagacattagcttatatctaggatcaccacaaattaattgaacttgtgtagggttaagaaaaacaagtgatagtagaataaccttgaccatttcatggtcatcccattttgtgctcccgaggttgcgcacttgattcaccaaggtcttgatccggttgtacatggcttgtggctcctccccttggttgagcatgaatcgaccgagctcccactcgatcgtttcccgcttagtgatcttggtcacctcatctccttcgtgcgcggtcttgagcacatcccaaatctctttggcactcttcaacccttgcaccttattatactcctctcgatttagagaggtgaggagtatagtagttgcttgggaattgaagtgtcggatttgggcgacttcgtcctcatcataatcttcatcacctacggatggtacctgtgctccaaattcaacaatgtcccatatgcttgtgtggagtgaggttaggtgatacttcatcatttcactccacctactataatcttcaccatcaaaaaccggtggtttgcctaatgggacggaaagtaaatgagtatgtttagaaatgcgagggtagtgtagggggatcttactaaacttcttgcgctcatggcgcttagaagtgacggacggtgtgtcggagccggaggtggaaggcgacgaagaatcggtctcgtagtagaccactttcttcattttcttcttcttgtcgccactctggtgcgacttgacgcggggaggtgattcctccctcttattgttgccggactctcccgatggagctttcccgtggcttgtgacgggcttcttgccggtcaccatctccttcttggcgtgagctcccgacatcacttcgagcggttaggctcttaatgaagtatcaggctctgataccaattgaaagtcacctagaggggggtgaataggcaaatctgatttttataaactttaagcacaactacaagccggggttagtgttagaaataaagtcgagtccaaaagagagggtgaaaacaaatcacgagcaaataaagcgaatgacacggtgatttgttttaccgaggttcggttcttgcaaacctactccccgttgaggtggtcacaaagaccggatctctttaaaccctttccctctctcaaacggtcacttagactgagtgagcttctcttcttaatcaattgggacacttagtccccacaaggaccaccacacaattggtgtctcttgctttgattacaaatggcttgggaataagaaatggggaagaagaaaagtgatccaagcgcaagagctcaaaagaacacggcaaaactctctcttctagtcactaattgctttgagtggaattgggacttggagagattttgattcaatctatttgtgtcttgtattgaatgcactagctcttgtattgaatgtgttggctgaaaacttggataccttgaagtgtggtggttggggggtatttatagccccaaccaacaaagtggtcgttggggaaggctgctgtcgaagggcgcaccggacagtccggtgcgccactggacactatccggtgcgccagccacgtcacccaaccgttagggttctaccgtcggagctctgacaagtgaggccatcggacagtccggtggtgcatcggacaatcactgttcactgtccggtgcgccttttggcgcctgctctcacttctgcgcgtgcagtccgcactgttcactgttactgtacacttttgcagacgaccattggcgctgttagccgttgctccgctggcacaccggacagtccgacgctacatccgacagtctggtgaattatagcggagtggcattcccagaaacccgaaggtggcgacggtgcgccagaccagggcagccttcagttggttttgctcctttttatttaaaccctttcttggactttttattggtttgtgttgaacctttggcacctgtagaacttataatctagagcaaactagttagtccaattatttgtgttgggcaattcaaccaccaaaattatttaggaaaaggtttgagcctatttccctttcagccgccacccttgccgtcgtcgtcgccattgttgccatcgtcctcgttgcatgctcacgatgaggttgtacctgatggatcgcgcagagcatgctcacgatgaggttgaggtatggcgtgttctgtacgacttcatcctctgtcaatgctcttgcgtcaccttccatcatgcgtgggcatgcaccaggtatggcgtgttgtcatgtactttctggtacattggttgttactatggaggctttgttgctgtggtctcccttggtactgcatacatggcctaaacacggttgggtgatgttgtgtcttgtcgcggaagtcgtggatcgatggtgtctgtctgggttccctccttgcgggttcgcgtggcggggactcgatcgtccgtcctgcctcgtaggcttgcctgacgaggacttggtcgttcgtcctgcctcgcaggcttgctcggcgaggacttggtcgttcctcccacctcgcggacttgctcggcaaatgggtcgtggagagtatgggcctcactatgggcaccccatttcctggtacccgacatagtgactaaaagtgactaaaatgagctttttaccccaccacctgccctcccccacgtgagctatgcgctgaacgagcaaagaagtaaataggggtaatgcagtaaatatacgtagtagttaatgctctttagtcagatttagtcactgacaccaaacgagatactttagtgactactaaagtttagtcaggtgactaaagaaaccaaacataacccttagtgtgaaccgatttaggcacactagcatatatcccgtgttaacgctacgatcttgaagagggaggagtcaacgacggcggtggcgcaagtggataagttgacgacagcgacgatgacaatgtgagtgaggagaagggggcagtggggacgcagaggatggaagagggggagggggtggataggggcagcagggtgggaggagggagagcgcgagtgagggagagagggcgccgggacgcatgggaagaggaagagatgaatcaaataatattatatattaaatttgagtaagtaagagagatttatctaacgatccgaattgttggttttgatgatctgttaagtttaggtgtaatttgtttgatggatttagtgatgattatatgtgtgggggtgatttagtttggttggttttacaaaagtttaaattttttttagattatatagtggtatagatagtcaaacagtagcggcaatgacatcacggtaaatgcgcgttggcatccaaatgcagctggacacaggtcacacagcctaacggatatatcatatatgtgaatcctaactgtacactgtctgaagtggacgaacggctctggcttcggcgtgttacgtgtatagtaggccccttttgaacgaacggcgcgggccggggccaccaccagcatctgcggcagggagaatcgcgttggttcgacgcaaacgctacccggcgcccccttgcccttggggccggctattttaccgcacccgttctcccctctctaccgcagatcagatcacactcgtagagagaaggaaaaatatccccaaaccctagctcccgatctcg

SEQ ID NO: 325 - DNA, 10000 bp, Zea mays
caagtctcaataagaaacaattaaaaattgatacaaaggcaaaaaggctaacccctcacaatgtttttaacttagggatgtttcaagatgacaacattcatcatgattttgacttcctacttttccttgtctcaagcacctcgcctgcagaaccaaacagggtctaaatgtggttatattcatgttgagacttttttcactcatgtaaggttcattagaatgatttgcatgatataaatggaacttctgttagtccaatgagaccataactgcatgatcatgtacggatgcatctaactttgtaccaaactcttgccaggatttacttgatgatgctgagcaaagtatgatagagtacaaaatatctattcagaatttgaagaaagaatcaaaatacactcttgacaaagtagctatcggtgaaagtgatctgtagcgtggacaaaccgatttgaggtattttacatgaaccttggtcggaaaaacctgtttttccatgtctgtttctgtttcatttaataatggctcgtcaccaacatactgtaaaattattgtctgtgcctctcaccagatctactgggaagcagatccaatctcttataggttccatttacaaagcagaatccacaactgcaggtattagtatttcttcaggttatttggccaattatttacagtggtctacacaacggtgggtctagagtcattttagctttgtccagtcatatttctctagctttgacaagtttatacaaaaatacgttagcatctaaaatatcaaataaatacactatcattccatggtgtatctaatggtttaatgttgtcgattctgcattttttaataaacttggtcaacgtagagtagtctaaattaggacaaggctaacataacttgcataattgcagttggaatagtaatcaaaaccttcatgtccacgacttgcacgtaatcaagcaccaccagtatcatcttccagaaggaagaatcttagttgaagaagcaaggaactgttgcctccaactcgtcagcttcaaagtcagtcgatggtgagtggtctgggaaatggctaaacttcgagagaggaaaaattatgcgaactactgcccatgattcgcctcatcgaacattctgtgtgtaagacggcatgacaaaaatagacgggcacatacctatacaggaagtacgtccatgtcggcctggagcgcgacgatgggcctggccgcggcgccagcgatggtggccacaacgccgatccgagcaacgagccacctgtacgggatgcctatcgcgtcgagctcggcccgcacgggctcgctggtccggagctcctggcaggccaactcgggtcgctggtggatgcgccgccgcatgccgtgaagcccaacacatgccgcgaaagttcggagcacatagctggcgaaggcacgggaggagctcgtcctccactctggcaggcgggtggcctaggtggaggtgcagagctctgctcggcctcgacggcgtctcgatctgggcggccctgccttgctcggcctcgtcagaaaagggaggaggcacggtggggcccgacaaccggttgccacgaaggttgaggcggagcaacggcaaggaggactgcggcgagaagcgactcggcgagaagcgactgggcgacctcatcatcgtcggctatggcgtcggcgccgccagggggggcgaagatgtcgttggcgtccccaacttcctcccacatcgagctcatgttgtccctcagcgctatcatggatccggggaatagaaggctttgggggaagggatccaccgcggctgagcgagagacattggggatgggatcttgggagaaaaggaagcgagagagagggcggggggcagtgatccggaaagagggcgagagagacgaagcgcagtggcgaggaaaccgcggtcgaggatggaaaggagcgccgtagaaggaagccgcgactgcttgatttgaggaccgtgactgcttgattcgaggatggaaaggagcgccgcgggcgggtgggatgcgaggaaaccgcggtcgagcggcggtggtgaggaggatggtggcagaaccgtgcaccactggttgtggacgtctacactacatacttatatagtagtagagatttagagtaccatcaagacattgatattcttctaacacttgttggacaaccagctgagaatcaccaaataccttcacacgttttactcccatatcatttaaaagttctaaaccgaataggagggcctcatattcagcttgattattagtgcaataagttttcaatcggctagagaagtcaaaggagacattacttggtgaaacaagcacaatgccaattccttgtccttcattgcaaaccgatccatcaaaatataaagtccaaggagtaatagtgaggtatgacatgtctagttcatgaatatcattaacccgatgttctacaataaaatccgctacgacttggcctttcatagatttcaatggttcataggccaagtcatattctatgagtgcataagcccacttaccaattctaccactcataattgggttatgcaacatgtatttgattacatcagcttgaccagaaacagtgcaatgactagacagtaaataacatctacatttggtgcatgcataaaacaagcataagcataacttttcaataaaagtgtaccttgtttcagcatccaccaaccttcggcttagatatgtcaccacatgctccttcccctcagtttcttgtgtcagaacagccccaataaccttgtcttcagctgcaatgtataatctgaatggtgctcctacttgtggtgcttttaacacgggagccgaagacaagtattttttaatgagatcaaatgcttcctgctgctctgccccccaagtgaattcagcatcattcttaagccgaaggataggggtgaaggcatcaatcttcccggctaggttagaaataaaccttcgtaaataattcaccttgccgagaaacctctgcacttcgaccttacaagtcggaggccccacattccgaatagacttgattcggtcagggtctatttctataccatgttcatagatgacaaatcctaaaaacttaccagccgacactccaaaagcacatttacgtgggttcatttttaaaccataccgacgcattttatcaaaggctttgcgcaaatcagctatatgagaactaaacttagccgatttgactacaatatcatcaatgtagacttccacagtgtttcctaacaactcatggaagatcagattcatagccctctgataagtagcaccagcatttttaagaccgaatgtcatgacaacccattcaaataaaccaataaagcctggacatataaaggccgttttagacgcatcttcttcggccatgaaaatctgattatatccggcattaccatcaaggaagctaataattctatttcctgatgcattattgattaatgtgtcggctatgggcatgggatattcatctttagggattgctttatttaaattacgaaaatcaatgcatactctaagtttacctgactctttcttctccaccggcacaatattggagacccactctgcgtatctgcaaggtctaataaaattagcttctagcagccggtggatttcgtccttgattcgtgggagaagatctggacgaaatgttctagctttctgcttgaaaggtctgaaaccagacttaatgggcagccgatgttcgacaatctctcggcttagtccagacatttcagtgtaattccaagcaaaacaatctgaatattccttcaatagaccgatcatctcatttctagaatcggtctccagggtcttgtttacaaaagtcggccttagagttttaccatttcctatgtcaatctcctccaaaggatcagccgatgtaaacccctgtcctagtttatcaagatctctgaattcctctatcatgtcccccacagaggaatcagatgatctttgtgtgatggcggactttccggtctcggggaccggatcatccgtaatactatcttttcgctgtggtagatgttctgtcttaaagtccgaactgttctgtgaaagaccagaccatccggttttgagggccgaattgtccgtgatcaaagactcatgaactttgtgtgtattcatcatttaaactctatttaggatttagccgattctccatcggctctagcattacaggaatgaaacctttcttatctatacttatgaactgataatcagaaaaatctacccctgtgagacatgtagcagtctcataagtccagagtacaggggaatcggccacagcgatgcaggccgatacatctgcatgtacttgttctacctcatcgcctacccattgtattagcatttgatgtaatgtagaaggtatacattgattggcatgaatccaatctctgcctagaattaaactgtaattcccttctacatcagcgacgaagaatgcagcagcaagggtcttagtcccgatggttaattcaacggacgtgactcccctggctttaatcgaactatccccaacaccgctgagggtcatgttggttttgacaagttcgtcatcttgtttacctaattttctgtataatgaataaggcattagatttacagtcgcccctccatccaccaacatcttagcaatcggtattccatcaatgtgaccgcgcacgaagagcggctttaaatgatttaccgattcctttggtttagtaaaggcggcttctttaggaccaaaatcaaactgggcagcaacaggttcatcgtcgccaatgatagtacaatcggaagaaagtgtaataatatttacatccatacctgggcgttctggagaagcctcgtagtcgaccaggtcttctcctagcaggtcgtcctcttccattaatgttgttgtgttgttggaggcttcctcatgaacggcggacggtccgcacgcgggggccggacggtccgcgcctggtgcaggttgtccagagccttcctggtgaacggcggaaggtccgcacgcgggggccggacggtccgcgccctggtgcaggttgactttctatttctatggccgtttgttttttctcaacggccttcggtctccatttcttttgcggtggcgggtatagtggatgtgtgtcattaaatgtcttttccgcctccttctcctggctctcctttgctcttaggcgctgtaattttctcttttgggatcgtgtcaatcccgctgggcaccatcgaggcatggagtattttggatcggctgttttaatggtagccgtatccttttcggttgtgttggccgattcgccgaaaatcatcggtcctttattgtctccctgtatgacaacatctgcagtgcctattttgatgatgtccttttttgttgttctttgagttgctacaggcatatgccccctgccggattggtcggcctaggaggccgagtagttcggcaaccttgttgggcctgtgcctggtgaccggattcagcagtgctcaatcggtcttgcactggcggtgccaacctatcaaaaacggatgtttggggtgccccccaggcggggtactgtggcatcccaaatggatatggtggcatgccccacatttgattcgggacatatggtggaggtaagtatgtgtatggatatgacatagatggataatgaggtggaggggtccatgtcggcatgttaggtctcaattgtacaataggacctttcatttcttccgattggtgacgtggcccaatcagcctgacctgacgttgctcatgaatgggtgagcgggtcgcttcggtagccgatcactggggccagccttctttttcacatatttagacaacaattgatcgaaagtcgggccaggcttgatcagccgaccagctgctttaaatgtatttgttttccacgtacctatctctggtcgtcgtggtttgaaggtacgtggtcgttgcgagtcctgagcatggccggaccgtccgccggagctctccggaccgtccggtggggtcccggaccgtccgcgcctacgtgccggaccgtccgggatacgcagcacgggttcctgtatctgtctccctgtctgcgcttgccccccagtactggaggttgtgatggtcacctttagggtctcccctccatcgggagtcttctcggctgccactttcctgcaataaactttatgatcctcatcggcccttttggaattgccgatgattgcctctttgcctttgcctttatcggccgtgtttggccgaaccaggactttcttgccctcaaagtcaatcacgttcattggaaatggctctgtatccacctgcatttcctgaaatttcaatcgtccctcattaatggccgattgaatctgtcgttggaatacattacaatcattagtggcatgagaaaatgagttatgccacttacagtatgcacgacgttttagctcgtcggcggatggaacagtgtgatttattttaatattgccatttttgagtaattcgtcaaatattttatcgcacttaccaacattaaacgtaaacttaacctcctcttgtcgtttcttttgaaccggctacaaggaggaacaagctgaagatttggcctgttttggccaaaccatttcagcagcatatacttctgctgattcgtcgtctgagctactttggtcgcattctactatatgtacgttgtgacgcattgttttagtagtttctttgctccggctttcgcaagccaaagccctctggtgtaactgtgctagtgtaaaaaattggatgccttctaatctctcttttaaataataccgtagaccattaaaggctaatcctactagctgtttttctgctaaatgaatttgaaagcatcggtttcttgtatcgcggaatctccggatgtaatcattaaccgattcgtcttttgtctgtcgcaatgacactaaatctaccaaatccaattcataatcaccggagaaaaaatgatcatgaaatttttgttctagatccccccatgatgaaatggaattgggaggtaaagtggcataccatgcaaacgcggttcctgttagcgataatgaaaataaacgcacgcgaaatgcctctgtgtctgccaattctcctaattatgctaagaactggcctatatgttcgcgcgtgtttttcccttgatcacccgaaaatttcgcgaattcaggtattctagttccctgtgggtacgggtggtgatcaaatcggctgtcataaggtttccgatatgattgccccccagggaccatgcttactccgagcttatctcggaacgccccggctatttcttccctcattatatcaatggcagccggtgcaagaccaccggctctctggtcaaacataggtggggttggttgcatattagtatgttgtcgttccccccattggtttgagctaagtggtgcatttccatttgctctatatggctcataggtttgatcgtttctttccagccttttaggtggggccggaaagctttcctgggctctggatcctgaattaatgggctggtgcattgcataatgtgatgggaagtgttgctgggacgggcgaggattcaggtaataatcctcctcaaaagactcatgcgcggactgtccggatatgtacccggaccgtccgtggtcatatgcggaccgtccgtcattgtatgcggaccgtccgactgggtagtttgggttctgtgtcatatgtggtggctcgggcgcatatctaggtaactcatttaaaataggcccgactgctgttggcctggacggtccgcgctcacgtgcggacggtccgggcatgtgcagatcggctggtttgctgccgatttgcggttgcttagggtatgtgtccatcggcatcccataaaggggttgtgactggtcgtgacaacctgtagccgatgtgttacgcgtgttatctcctaactcaacctcgtgcgaaggaaaatttgcggtactagatttatcaaatgcacgtactagtctcttaagatcgctttgcataccccctatgatgttctgcatttgttcacgctgatcttctacataatttctaagagattgcagatcgttggtattacttacattggggatatctggcgtgggttggagcgaagccggatccgtcgcccgatgtcggacgaccttgttgttcctgtccactttgaagttggccaagaactttgctttcgcctcctggatcatccgctccttgtgctcctcaaactggagctgctcgtcagccggcaaggtttcccaagtcggctctatgatgttgcttagagaaatatcagagctatcctttgaaccggccattgagggtcgatttgatgagcctagatgttttttccccagcggagtcgccaaaaagtatgttgacgccttttcggagcgccaaacactcaacaagaaccgtggcggtgccctctgcacaggggcggacggtccgcgcgcggggccggacggtccgcggcctggtgcgaggcgcggtggtactctctgcgcaggggcggacggtccgcggcacagggccggacggtccacgacctggtgcaggagctcgggttccctgcctgacggccggacggtccgcgcgtacgcagggacggcgggagatcgccgacggcgcctggatctcgctcctgggagggaccccgtcggggagtagagatcctaggttgtgtctaggctcgggctggccgacctaaactcctctaatcgacgtagagtcgaggagagacgaagaatttggggattggatagctaaacctaaactagactagaactactcctaagataaaatgtgaaatagaagttgtattgattcgattgatgattacaaatcggccgtatacctctctatttatagaggaggggggctgtaccctttacaaactaattccagagcttatcccgcgattttagctaacaaccgtagcacaaaactcggaaccctaatctgctctgcgcacgcgcggaccgtccggcccacaggcgcggaccgtccggcctcagggccggacagtccgccggctcatttctggttcgaacaccatgattcttgatccaaaatccgatccaacataaaaaaccgacctaaagccaaaaaagcttgacccaacatgtccagcagggatgcacgagccaactcgactcgatactaggtacaggtcagacacagaccatgccaaacaacacatcacccgattttgaccacccgacatttaaatagatctagattcaagtccctggttcatatcaagtatgcagaggaaatacggcgacacgacgagtgtgttgaagcatggcttcactagatgacacatgatttagggcttatttagttcgcggatgactgtgccacactttaactaatattagtcgtcggaattgaaaaactattactcatcggaattgaaatactaactttataaaaaaactaatcaaagtgtgacaagttagacatcaaataaacctttagttcattttattagagtaggggttaatatggaaactccaacttttggagaagacaaattatcgttagtgtgtgcgaccgtggccaaacgatacggcaggcgctgccgcgccggtccagtaaatataaatcgtgttcctttttcttttgtttaaaatgtgggagagaaaaaaaagaaaatatgtaccagtagagatatcaggcccatcaatccattaaataatgactcaccaaacctttattctagcccaccaacaccgacgaaaggcccatttattccagcaccacgctcaaatcgatctggccatccatcccagcgacaagacgccatccatccgtccaccgggtagggtttctccagaattaaaagggccgaaggaggcgcccttaaaaacccttccattcacccgcagctcccatcctctcgctcgccaggagaagcagccgccgttgctgctgccgcgtccacaga

SEQ ID NO: 326 - DNA, 249 bp, Zea mays
ctgagcgtcggggaattgagaattggggaatcgaccagaaaggagacgagagtgtcacacgtacatgggccaggagagtggtgggcctacaatacattctaggaggtccatcgaccaccccaaaaaggcccagaaggcctgaaaagcaaaaccgtagaagatcactacttcactagctagggttttcatccgtgacgaagtggtctatataaaaggtcagaaccgaaaccttaaccttattcggcgact

SEQ ID NO: 327 - DNA, 2616 bp, Zea mays
agatggggtacaatatttagactcacaaccctaaccctaatgggtcggcaacccaacagtggtgccccccacacaatataacatccacccgtagacgcaacaggggcaccacacatgatgagactatagtagaggccaaaggtaggagccgacaagttgaaatccctccatagtcgcagcatcgtgagggtgcgaatgttgcggcaggagaagagaccagtatggattccgagaaggctatagcccctagatgccgagttagccgaagtcgaggtggccgtggtcgggagacacgcattaggagcctgttctttggaagggttcgacgttcgagcatcaatgatcggcagggcgacacaacaaaagagcaccggcaggccgacctttctgcttcttcgttcgtccggacgttaaggagacccgccagggaggtcgacggcagctcatgcgtctgcatcgatcatggtgtccgcgcccgcggcagaatagaaggggaacgacggatccgaccagggaggccactggagcgatggatccggccgagaagacgcgatccggccaaagggacgacagatcgagccgagaaggtcacaacaacgtggatccgggcgggaaggccgcgacagcgacggatccaacgaagacgatgaaggggagggtgacggggcggttccagctggacatgggcctactccggacctagcaagggttgtcgacgctagcgacggaaaatgctcatgaggttggcgcaactgggtggcggcggccagccctggacgcggcggctgcgtggatccgggcggcgctgtagagccttaggagggaggggtgagcagcgcagggccctactcggccatggacgaggagtcaacaacatagaaggagagagagagccactgtcgtgggcgcctgctgcggtggtggcgaggccacccacaccacaggttgtcgcggcaaggtcgcccacgcccgctgcagcggcagtagggcaaagaagcgtgccccgcgacgaatctgggcccacgagcagcgccgtggttggatctaggcaggcgagcagaggttgccggcagggaggggtcgtcgcgccaccaggttggaggtgaggggtggccgcactgttgggagggggtggcgcgcccatcgacacgagcggctgtagctgcgatcgtgaccgagagggggggtggggtgggcgcgcggctgagggcagccgcagccgcaagcaggcgagcccgcccaccgccaccactccacttgagagcgagcaagcctaaggagggcggtcgtcggggcaacgccgagccgcgggcgcacgcacatcgaggagagcgcgacacgggctcacgagcgcgtggacgcggacgcgcgcagggtaggcagccgacggcgcgggcgtgcaccgcgaggcacgagcgcgcgtgtggacggcgggtggcaccgcaagggtctccggcgcggattcagcgggtgggagagtaggggcacagggcttggcggccagggaaggcttggcctacggaggggaagggaagctgccccctgcccccaggagggagggttgagtctcccgggggtagcagctaggaagacagtggctggctatgggggtgggtggcgcctgttgtgggttggggaaaccctaatcctaaatctagtatgataccatgtagaatgtagaagtataaagtgtttgatatattgatatgagaggtttgctacgacaaacaatctattagggtctccaagttgcagttgatcagtgtgaggcttgctacgacattcctccttttttttatcagctgaagcagtacacaggaacagtgtttcttctcctactcaaccagcggcagcagctgcggctacagcctacgagcgtttttgttgggcaccggtgccgctggttgctaaggtatatagagctagaatggcatgacagggctatgttgctgctcctttcagattcaccatgtatttttgggctgtcatctatgcaaatgtgttagtttgagtgtagcgaatcttacaacaaaactttcttgactccacccttttacctctaaatgttgcttgacttgaaggtggactgtagcctgtagggtagtcctgtactagtcacgagctctaccgttcagccctcatttttgctgccagggtgaacaataaattccaagacgaaaaaaaacatcatctagcagagtgtaaagagtaaagacgaatccaaggtaccagcatagatactattggaattccaaattttggagaacaaaactcgtcagagtggccaaacaatacagcggatgctgctccagtacaaaaaaaaaaaacaggcccatcaattcatgaactcatcactcaccgaacatctctaccattctagcccaccaacaccgacgggaggcccatttgtcccagcagcacgctcgaaccgatcctggccatccatcccagcgacaagacgctatcggcccgtccaccggctagggtttccccagagttaaaaggcccggaggaggcgcccctataaacccttcccttctgtcgctgctcccacctctagcccgacaggtgaagccgccgccgctgcagtgtccatagccaccgcaggagactgag

SEQ ID NO: 328 - DNA, 9481 bp, Zea mays
atttttgaagaatcagcttgattcgttcatagaatcatttatgaaaggtttgaccctatttcacaccaattgatcgtcacttcttctaaagatagtaacactacatctgtaaaaagatagttgtagcccattttgcataattaagaaatggaaagcaaattgtaatctaaagaatctacaagaaaaacattggaaatagaatggtcaggtgatatagcaattttacccaagcctttgaccaaatcttgatttccatccccgaatgtgatagctcgttggggatcttcgtttttctcataggaggagaacatccttttcccccctgtcatgtggtttgtgcactcgctatcgattatccaacttgaaccaccggatgcataaacctacaaaacaattttaggccttattgttaggtacccaaacagtcttgggtcctttgacgttagaaacaagcaccttgtgtacccaaacacaagtctttgaactcttgtgtttgcccccaacatatttggcaactactttgcctgatttgttagtaagcacataagattcatcaaaagtcttaaaagaaacattagctcatttgatgcagtaggaattttctttctaggcaatttaacatgtgtggtatgcctagagctagatgcctcattcttatacataaaagcatggtgagaaacataatgagatttcctagcatgaatcttcctaattttgtgctcaggataattatcaggatataaaatatagccttcattatcctgaaccataggtaccttgcccttcacaaagttagatattttttaggggcattaagcttgacattgctcccctgttggaaaccaattccatccttgatgccaaggcgtctcccattatagagcatgcttctagcaaatttaaacttttcattttcaatttcatgctcattaattttagcagttaattgagttatatgatcatttgttgtttaattagagcaaggtgatcattaatagcttcaacattaatatctctacatctagtgcaaatggaaacatgattaacaaaagatgtagagggtttgcaaacatttaattcttctatcttagcatgtaatatgtcattctcatttctaagacaggaaatagaatcattgcaaacattcaattttttaatcttagaaattaagctagcatttttagttttaagactagagattgagtcatggcaatcatttaattcatcaatcttagcatttagactagcatttttatttctaagattgataattgaatcatggcaaatgctaagctccttagtcaagttttcacatttttctacttcctgagcataagcattctttaacttaacatgttttttgttttctttaataaggaagtcctcttggatttccaagagatcatccttctcattaatagcttctattaattcatttaattttttcttttgttccatgctaaggttggcaaaaagaataagtaaatcatcttcgtcttcactaaagctaccctcatcactagatgttgtatatttggggatggccctagagtgtaccttctttctcttgccgtccttagccatgaaacatttgtggccgacgttagggaagaggaggcccttgttgacggtgatgttggcggtgtcctcgtcggaggaggagtcggtggagctctcgtcggagtcccattcccgacatacgtgggcatcgccgcctttcttcttgtagtacttcttctttcccttcttgtcatcatccctgtcactttcactagacattggacatttagcgatgaaatgaccgggcttaccacatttgtagcacacccttttggcgcggggtttgtagtccttccccctatgcttgaggatttgatggaagatcttgatgatgagcgccatctcctcgttgtcgagtttggaggcgtcgattggaagcctacttggtgtagactccctcttttcttcttccgtcaccttgaatgcgacgggttgcacctcgagtgtggaggtggcaccttgctccaagttgacgatgtgtttggagtctttgatcataagttcaaagctcacaaatttaccaataacctcctcgggagacattagtttatatctaggatccccacgtattaattgaacttgagtaggattacaaaatacgagggatctaagaataaccttgaccatttcatggtcatcccatttggtgctcctgaggttgcgcacttggttgaccatcgtcttgagccggttgtacatggcttgcgactcttctcctttgttgaggacaaatcgaccgagcttcccctcgaccgtcttccgcttggtgatcttggtcacctcgtccccttcgtgcgcggtcttgagcacgtcccaaatttctttggcgctctttaacccttgtaccttgtgaaagggaaatgtgcccttgggccatttctaagtattttggtgattgagtgccaacacaagtgcttttgtgctaatctatgcaaaatggtggacaaagtgcaaatcatatcaaaaggtatgtttctagacttagtacattgttttatggactaatgtattgtgtctaagtgctggaaataggaaagattgaattggaaatgagatggctttgttcagccaaagtctgctcagtctgggtgcaccggactgtccggtggtgcatcggacagtgtccggtgcgccaggctggctctggcgaacaggctgctctcgggacttcgacggcggtgtacggctataattcaccggactgtccggtggtgcaccggactgtccggtgagccgttcacaggcaaactcgtcgctctcgggagatgattaacggcgtacggctaaaattcaccggtctgtccggtggtgcaccggactgtccggtgagtcaacagtcagccggggcaacggtcggccgaggatttcgcgcgtgacgcgtggccgagccaacggtcacattggtgcaccggactgtccggtgcgccaacggctctcagactccaacggtcggtttcgccaaatgaggaaggatatctgcaccggacagtgtccggtggtgcaccggactgtccggtgcgccagtcgacagaaggcaagatctgccttccaggattgctctcaacggctcctagctgccttggggctataaaagggacccctaggcgcatggaggagtacaccaagcattccttgagcactcttgatcactcatactccattcttgcgcacttgttcgacattctagtgatttgagctccattctagtgtgctagtcttttgagcttaagtctgggtcttgagtgtgtgtaattgctgtgatcttagtgtcttgtgtgagttgctaatccctcccttactccgtgcttctttgtgaatttcaagtgtaagggcgagaggctccaagttgtggagattcctcgcgaacgggattaagaaaagcaaagcaaaacaccatggtattcaagtgggtctttggaccgcttgagaggggtggattgcaaccctcgtccgttgggacgccacaacgtggagtaggcaagcgttggtcttggccgaaccacgggataacactgtgccatctctatgattgatctcttgtggttattgtgttttgttgagactcctctctagccacttggcgattattgtgctaacgcttaaccaagttttttttgtggcttaagtttcaagttttacaggatcacctattcacccccctctaggtgctctcaccttgttatactactctcgacacaaggaggcgaggagtatagacgtggcttgggagttaaagtgctgaatttgggtgacctcatctaaatcgtagtccttgtccccctccttaggtacctacgctccatactcaacaatatctcaaatgcttgcgtggagtgaggttagatgatgcctcatttgatcactccacatgcaataatcttcaccatcaaaatatggtggtttgcctaagggaacggaaagtagaggagcgtgcttagaaatgcgggcataccgaaggggcatcttactatacttcttgcgctcatggcgctaagaagtagtggacggcgagtcggagccggatgtggagggtgacgatgagtcggtctcgtagtagatcactttctttattttcttcttcttgtcacccttcctacgcatcatggtggaggaagaggattcctccttatgcttgtggctggactcccttgagagggttctccttgagcttgcgggcatgtcgccggtcacgatctccctcttggtgtgttctcccgacatcacttcgagttgttagactctaatgaagcaccgggctccgataccaattgaaagtcgcctaaaggggggtgaataggcgtaatctaaaatttacaactttaaatacacactacaagtcagggttagcattagaacttatatcaagtccgggagagagggggaaaacaaataaaatggaaatcaagcgaatgaacacgatgatttgttttaccgaggttcggttctaaagaacctagtccctgttgaggtggtcacaaagaccgggtctctttcaaccctttccctctctcaaacggtcacttagactgagtgagccttctccttaatcaatcgggtcacctggaccccgcaaggaccaccacacacttaggtgtctcttgctttgattacaagtcgctttggaacaagaatgaggaaggaagaaagcgatccaagcaacaagagcgcaaatgaacacgaacacacacactctcaagtcactaggtggttggaatgaattttggacttagagaggctttgatctttagaaaagtgtcttggagtgaatgcactagctcttgtattgaatgagaatttcagaaaacttggatgcttggagttgtggtggttggggggtatttatagccctcaaccaccaagaagccgttggggaaggctgctggcgatgggcacaccggacagtccggtgcgccaccggacaggttctgttcactgtccggtgcgccgccacgtcacccaatcgttagggttcggggctcggtcgaccgttggagctttgtcttcttgcggcaccggacagtccggtgctcctctgacttatgtgttgcactgtagctacactgttcacctttgtagagtcgaccgttgcgtgagttagccgttgctccactggcacaccagacagtccgatggcacaccggatagtccggtgaattatagcggagcgcgcctgctgaaacccgagagtggttggttcaaccctgtacggacagtccggtgcgccagaccagagcacacttggtttcttttgctccttcaaattggatccctaacttgaatatttattggtttgtattgaacctttatgcacctgtagaacatgtattctagagcaaactagttagtccatatatttgtgttggacattcaaccaccaaaattaattgtgggaaaaggttaatcctatttccctttcaccttcccttttatagtccaagggaggcacattacaagggagctaaagcccctactggtggtcctaagagtatttacaacatggaacattaaatgccagattgggctaacaacgctagatcttcctgagcgtgtatcccttcttggtcgtcgcgctggctcttgacatctcatcctcctgtttagtctaatcggattacatgtgtatctcttgttgtaggttgcggcatagtctgatacactatcatgcgtaggtgtgggcggtgtcgtctcgtctcctccactcgtatcttcatgcatcggtaacacacgaagaacagtataagtcataatgaagggcacccaaacgacgcattgggtcaatgctcttgcctcggtaacgtgcgagtaatagtaaatgccgcacgttgcagacttggtgcatcgcgcgcatttaatgcaggggatacactacctgccattgatgtgggtaagtatgggtcccatctacatccactgttggtgtgccctatgtcagaggctcatgttaggtacgtctagccacgcgttggcaccaaacctctacctggacaaggggtaggcccgggaataagtgatgacacggtattcccaggctctccatgatcgtgggcccaaaccacacccgagggttccaagtctcggtcgtactaatcaagacacgtggtgacatcagacctcacctggcctaaggtccggatggtattttctaggctcggagctactctgaaggcttggtgctgtagccagagaatgtcttcttctcaagggtcatgaggtccctccagacccctttctccagggattcgatgggcccacgaggaggtccgagttccatttgtaggatcctagatctatagttgaagttgtcaattcctccctttatagggcttttatggagatggtgatctagcccaggagatgagcttaccccgtccatgactccatatggtgggccttagctagccatccgtaaaaccctcaatggtagccattggggtcttactttgacatagctggagtgggtaccccatatttagggtatcgatagaggcccccagacccactttgggtgaggcggcgaacccgcaggtggggccatacccgcgtcttattctagaaatgccagtctcgtgcagcagcgctgtgcctgtagcttcatgttgagtaagttgcctatcagcatactgctgttgttgcataaggcaaacaaaatgacttaccctcgtgtttatcaagcttggtgagtcaagagtttctctttctcgccccctgtcactaaggctcactggaggttgtcccagacgtgggggttacctctaggccagggagctaccccccaagaatggttcaagaatagtgatgagcagcgtaagctaccccttagatttgttcaggagtagtgcttagcagcgtaagtgtcgtggtttcataaatcggggcacaatagatttgtgttcgatgggggatgctagcgtggactcacttcgaatgttgaaccaccaggggttcaatgagaaatctaagatgaggtttatactgattcggattcgcaccctactccagtgtagtgttaatcgtagtattgctttgagcatgttataataggtgtgctcgagtgtcgagaagaaagagggcctgcccttttgtagctaaagggttggaccttacataggagatctattttctacaagagagagatcagctcctctgggttatcgttgtgggtcctctgtaggatcgtgcgtagttgtactcctagtatggcatacctatcggtgtttagtgttcgacgcgtgtctagaatggacctgaatttttcactcaattcaacagaactttacaagtgttgtgttcgtgttttctcccaaccttggttagccagaagctgaggatggcacgcgccgcaccacccgtcgtccgacgccctccgaggcgcatccgtcgaccgcctatcgcccttcgacattggccgcttcgcggctcccccgttcgccacctcagctccgcccaatgcttgccagctcagtggtttttccttgtcggttgccatagagccacaaccaagagaaccatcgagccaggtcgcggcgcctgctacctgcgggctacgatggtgttcaccccactattgccgccatttctctcttccgtagtttcgtgaaaatcacacccgcaatactggccatgtgcccatctattattagcaagaggctcgtatttcttacctcacatatgttttctaatcatatatcattttatttgattttggtggagactatttctttatgaaaattcgtatgtgttaaccttcagtgttgctaaaaatagtagttcgtgatcgctttttgctaaaaaatatcgatcgtgtgtccattaatcatggacaagaggctactatgggcatgtttgttcagcttttttctgaccagcttttctgataatttggatgtggggagaatctggctgtgtggagaatctgagtaacattaggattacctgcggaggaagataaatgtgtccatagggctcaggatctagaaagtgacggattcataatattgcaacgactcaacagattatgtgtttatattgattttgaatggtttttactcaaacaaattttatagaatctggatgaaaagctgagtatttggcagtccgcggcattttttggtggccaaaagctgcaaaaatctgaaacaaacggggtatgtctttgcgaaaaatctatgtgcgggtgcccaagagcagtggcccacgtaaggcccaagcccaccacgttttctcgacgccacccgcgcactcctattagggttcggcatctctccccgtctatatataccttctgccgccgccatcctgaccctgttccccacccatatcgtgaacccgccgccgacgcagcagcaggagacgcgccaaggagagcccgcaaggaggcgactatgagggccaaggtacatcctccatccccctaactcctacgcgcgtgctatctcgtcacgtagattcctgtggcgtagcaactccttgacactccctgcctcgagtagctgtctgctcggttcgtccatgtcccgaagctgcgattgcaaagagagcgattcgtccatgtaggggcgctgcgattacaaagagagttgttcgtccatgtaccggggctgtgattacaaagagagaggctcgagtggcgcaattcttctgggacggcggatctcgccgtgcgtgcgtggcgcccctcgtcgcagcggacgggtctgtatctttggcatgggaggctgatctatgagctgagccgaacagtgactgatcgtttcgtgtgagcttggtatctcttgtcccgtggcctggctccgcatggtcatgccgctgcggtcggtggaggtgtcgcgcttgtggcgccgccgcctgctagcaggttcttccccggccacggtggaggttccttcgcatacatttgatatgagccccattctagttaggatatattattatgaaatctagttactagttaggatatagaactattgttctagcagcatctgatggtggctgaagagatgttgccagtgctttatttgttgagatttagatacttcgtgacttgattgatgatttgtttgcactggaatctggcacttgaaatatgtaatttactgtttacctaacttgtagatacctagcttttctacaatgatagatgtacactatgtataggtacatatgtatctagaaagtacaataacagtcctgttctgcgttttacttgcttgcattcttgcctcttttgtgctatatatttttcttgttatctaattctattcattttcatctgtcaatcttcagtggaagaagaagcgcatgaggaggctgaagaggaagcgccgaaagatgaggcagagatccaagtaggctgatggggattgtggatggtggtgtcggcatagttgtgttacgtttcttcgatgcgtgagttcatggagag

SEQ ID NO: 329 - DNA, 3280 bp, Zea mays
aaatttcatttgagtttcatcttcattaaatatctcaccatataaacaaggatgatgatataataacaaaaatttaataaggacatagatagagagagtttcatcaaaatgagatatttattttcatttacatgaacctcatcatacacgaagataatgtgacattttcagtaacagagcaatgaaactatacactgaaaatagcctaactatttatctaggctccgtgtgcagttcaaccttatttggttacctcggttgaagtgttctagtgtactagagctaatagttattggctaaaattagttgtagacatctaagctatttttagtaaattagttaatagtcagctagctatttgttagttacgtaattccattagcaattttttagtcaatcaattattaactctaatgcattcaaacaccctcttaagcagttggtggtatcccataattcttgtcaaatcttgcgtatccgactatgcagcctcccttcttcatccgccatgcagtccattcttcctgcactcgctatgcagcctaagataaagtagaaacccattttacattgccttacgcccttacccaagctataggtatgatatataaccacgatgcaatgcaataccaatacaatcaactactgagacctgtaatattgtttttgttagacagaaaaatcgtagtttcaataatgtttccaaacattttatcgatgggctctagcctgtttgtttcggtggctactttgctatagtttgtttaactttttctatctaatattagttctttaatagtaaagaaatcttaggcaagttgtaacacaattagtcgagaatcaagcatgcctctaatcctctagtgttatttttttgacaaattgtatacccgctatttttgataaaattatatatccactaacaaattgcttatttccttgcctcctaggatggtaatggatcaccatccaaatatttcttcacgataagttaggaaccttaattaattttagttcaaaaatgaatatgaataagatcctaatctgattcgattcttaaattttatagtgtaaaatgtagagcccattacaacacctactcctagcaaaatatgcacatcttgtcataaattttgctctactctttgtattgttgtatgtaatgaataatctttatatatatatatatatatatatatatatatatatatatatatatatatatatatatgtgtgtgtgtgggggggtgtgggggtgtgtgtattgatgtctcttggacaacaagattacacaaaacacaattagaataaaaaaatatcctcgtgtatataaacttgtccgtataccatattagaacacataaattttaggcaacattttttccatcaacattcttcaatcatcaaccaaaatttacggatacacaagataagagggggtatgtaaggttgtacgtaatgggctacatgataacatcaaagattatgcaagcaaatctcaatccaccaggcgatcataaacatcatagttcacatgcttcagttttaaagccatcgtagttcccgtgcaaagacaaaaacattagaattattcaatacaagttgcacaagatagttcaataaaatttaaaccacaatagtattatccaacaaagctagttcataccattatagtttctagtaaacaagaatagagaacatatattaagcaaacagaccacataggataaggctaaggatgtatttttgtctattgttttctgtgacatcgatctcgtttgcacgagtaaaactaaaacatgagaaaattccgataaaaaataggaatctagaaatacgaacggaaaacactaaaccatttttattcctgtttctaaaatatatcatctcgtttctgtttttctctgtaaatatgaaaacgatcagatcatagttaaaacggaatacagtaccggacgaaacaatatttctctctcgtttcccccttatagcatctccaaaagctccccagaagtctcccctaaatctatttttttggaaaaacacaaaaacatgtctccaacagttcctctaaagcgcccccaactttttcatagcccttaaaactccctcatttgtagctacaaatgaggggttttttgggctccccagaaacaaactgctgctttaagatgtttggttgaggagccaagtagaatggagtcgtttcatccctgattctaggaacggagccgttctgttctgtgtttggtaatctggaacggagcggctctgttttttgtttggttgcagagtgaacggaacggagcgtgactgtgagagcgggatgagaacggagcggctccgttcggttgattttttggagcggaatggttccggatttgaggagaatattccataattggagtcattccgttctagttcctttataaccaaacagcaacaaaactgggatagaatggttccgttctacttggctcttcaaccaaacactaactaagggacctgttggagaaatgattaaaatttaccctcacttattatttagatattccttaaaactaattttgagaagtcgttttatggagagctcttggagatgctcttagttcgtagatctgattgtgtgtatgtatgtaagcatatgcgtctgtactacgatccacggtaaaaaagtcacaaacatataataatagcgtcattcaataaattgataacgtaaagtataaatgaacttttaactctgtttgagtaaacaactcgtgcagagactgcaatgaaatctattattttttctaaaataattatacaagttgaggaaatgctatttgttccactaagcgacgatgtattttgttttttaaaaaaatcgacgaggtactgctcggttattattttcacatgcaccgcgcgttgtttttgggccggcccatttgtattgcgaatttgcggagacgaatatgaccgaatggagtttagaaagcccagctcacttaggattgtctattttctcaagaaaagagagaatgggcccaaaggcctaaacaccaaaacccgatccgcttatgggatgtcatggacatggagtctgggaccgtccggcagatgagacgacagccgtcggatcagaaaccctagcccgggaggctctccctattaatacccaccctgcaccccgcgggaggagtctttcctagggtttcgtcgcttccagccgccgccgcgtccgcctcgccaagcgcagcagccgccgcagcacatcgctctctcgatctcagcc

SEQ ID NO: 330 - DNA, 10000 bp, Zea mays
ttatcgtgtgtaatcgacaatgatatctccttaaattttaagtacctgtgttgtgtcactcgggttgatgctgtttacctaacaaatccgtttggattttttttgcgtaaaagattggttagtctccgaactagagttcagcacatctttcatctttcggcgaaagatgaaagtgtcatgaaacttaacgttgcccagaagcttggcccaagttaaaatcacattgtccgaaattctaaatgattgatgcacttgaaattcgaagaaatatgctgcacacacagcaagtcgggtctgtaggcagaaccgccaacagtcagcacctgcttaatcaaatataaatagcatcgtctcactttttttcccaactagtgtgtgatctgtgtgtgagtgtgagattggttcaaattcctatttgaattttagcctttttttactatttaaacatgggagcaggctacccattagtaggtggtaccgtggtagtcagcggtcagcacagccttccctaactatctcgtcaatcgtcagctgcactgcaatctgtggtcgcaacgcaacgtcccccgtcgtggccgcgtgctatcttcctcctccctccctccttgccgcacgcgtcaaaccttgcaaagagagttcggtcgacggcgccagccggcgatggcagcgccgcgccaccgccagggccacattgcgcagtgccttggcaggatcctcgcctgccgcggcagcgccaccgccgccgtcgctgccggcccaggcggccgacggctcaccggcgcggagttcgtcgacggcgtgcggagcctggccgctggcctcgccgaccgcggggtgcgccctggccacgtcgtcgccgccgtcgccctcaacaggtacctgcctgcttacctaggcgcatggaattcgttagccgcggaaacgatcgggggctgagccattgctgtacatgaacgcagcgtcgagtacgtgcagctgttcctcgccgtcacctacgccggagccatcatcgcccctctcaactaccgctgggtgcgtgcgtgctcctccacttcatctccttttctcggttcttacagcacacagcactcactccggcaaagagtgcaagtaagtttcgtcgtcgtctccccctgttctgaagcagagcttcgaggaggcggcgcaggcggtggagctcgtgcggccgacggcgttcgccttcgacggcgcgttcagctcctgggcgcttcggctgatggagggcgacaggttcccatccatcggcctctacctcctcctgggcgatccttgcaggaccggccgcgctgctgcaggttgtggtgaggttcttgcttgcgttgcatgcgtgggcattacaagagactctgcacgcacctagcacttgcaatttacacacgcttgctttcgtcttggacacatgttggtttcagctgtacccattaccgacgtcacggggagcctcggcggagctacggcagcggcggcgatggagcccgtgtcggctccagacgacattgctctaatatgcttcacatccggtgaaaaaaccaggctgttacagaacgaatagaattgaaatcgagaaacttggctacaggatgtatagctgatggtacgtactctgattctgatccaaccaggaaccacggggcggcccaagggcgtagcgataagccacacgtccttgatcatccagtccctcgccaagatcgccattgtcggctacggcgaggacgatgtacgtacggtttcaggaccccaacaagcactatcgcatacagtttccatgccatgttagcgactctttacgcagttcaggactcaagagaaccaaaagttgtatgacttccagaatttcgcatccctctctctactcttcggcccctgcaggtttacctgcacacagcgcctctgtgccacatcggaggggtctcgtcgtgcatggcagtcctgatggccggaggctgccacgtcctggcgccgaagttcgacgccaggtcggcgttcgccgccatccaggagcacggagtgacctgcttcatcaccgtccccgcgatcatggctgacctgctgtcctacgctcggtagcgatctccagagcactctgaaaccctacgagcccccgcaggccgcagccgctggtagtggtagtcaagtcacctaaccggagtttctcccgtcttcttcgaccaggaaagaggagatggcgccgggctgcgggaggacgacggtgaccaagattctgaacggcggcggcgggctgccgctccacctcgtaaacgcagcctcgcaatcctttcctcgggctgctattttctcagcttacggtacggccgtacggcgttctctgccagttagctcttcagtgtcatgaggattcattcgtcgtgtgcagacagtaacacgtcgactggatttcagtagctctgtaatctgcaacagggatgaccgaggcctgctcgtctctgacgttcatggccctcaccacgccaaagcttcaagagccggagccggagccggagacccaaccgtgcggccaccacggaggtgtctgcgtcggcaaaccggcgccgcacgttgagatacggatcggcatggatgacgacggcaccaccgccggttcttcgccgaccgggaacgtcttgaccagaggcttgcacaccatggttggctactgggcaaacggcaaggcggactcatccgagtgtgacaggaacggatggcttgacaccggagacactgggtgggtggacgaggagggtaatctgtggctcttgggaaggcacaagggccgcatcaagaccggaggcgaaaatgtttacccggaagaggtactcgttgttccatgaccatttcagagttcagactccacatgtcttcttccatcctctaacaatggcagacatgtgaacatgttggtttcacaactaacgcctggagttgttcaggttgaatcggtgctgtcccagcaccccggagtggcgagagctgtggtggtcggcgtgccggatagccgtctcggggagagagtcgttgcgtgtgtcagcgtcaaggacggctggaactgggtggatgcgagagctgagcacgagcaccgaggcggaggcgaggaggtgtctcctcagatcctccatggccactgcaggacgaaagaactgagcaggtgttctccactctcctcatgtacagatgtactcttctgatgagaaacatgttagcgcgtgtggtgaacgcgcgtctgtttgagcagcagcaaaggtttcttggttcttaccatatccttttctttttattgaacagatttaaggtgccaaggtcttattaccagtggaggcagccatttccggtgaccacgacggggaagatcagaagggaggagctgaagagggaactcctggcagcaattcgactgcccagcaacctgtagctttttgaggcgatgatctgtttttggaccaaatcttggttcagttcgactccgattgaagtcttctgttttttttggtctgtaggtgcttttagcttttacctggttggagtttaagatgcgaaaaaaagagcgtttgattattggaaacctgtaacatccatgacttttcttcaccttgacaaaagaagtcgagtcaatggcaagtcccatgaaattcagagcatccgattcttggagaactgaaaattgttgacgccttttcagagcgccaatcactcaagaagaaccggcggcggtgctctctggtcagccgcggacggtccgcggcctggggctggatggtccgcgacctggtgtgaggcggcggtgctccctggtcagacgcggacggtccgcggcacaggaccggacggtccgcgacctggtgcagcaggagcccgggttccctgcctgacggctggacggtccgcgcgtgcgcaggggcggcagaggatcgctggcggcgcctgaatctcgctcccgggagggaccccgtcggggaggagagatcctaggagttgtctaagctcgggccggccgacctagactcccctaatcgacgtagagtcgaggagaggcagagaatttgaggattggaatactaaactagggctaaactagaactagactagaactactcctaatgcataaggtaaaaacgagtaatagacttgatttgttcgattgttgggggttcaatcggccgtagcccttcatctatataaagggggaggtctggatccgttttcaactgtttcccgagttaatcccgcggttttaggtaacaaatcccgcgagaaactaggaaccctaactgactctgcgcgcgcgcggactgtccgcgtcaccaccgcggacagtccggaccgcggaccgtctggcctcagggccggaccgtccgcattgctctttttagagctcaacatatgccccctgccttttggtgaaggttgacgaaccaaaagcatatgaactaatcctgatgtaggtcaccggcttttcgatatggagattgttcaataaagcaccaatataaaggccgtttcggattgtatctttctcggccatgaccatttgatcaatggatcaaaaggaatagaatggaggtgccccccagtctggatagacgaagggactatacatgtaccatggattcatcatcgtgccattccatgtttgaacaggataatataccgacgatgagtaaataggtggaaagtaccctggtctcatagaatgaataggcgatgcttgttgtgtcgcctttcgggtcgttttgtttgaccgttttgttttagcaggtgaccggggtttctttgttgaccgatcacgtggaacagtctttttgctagtatttttggagagcaactgatcaaaagtaggatcggctttgatcagccgattgtatgtgctttgaccttgcgtctttttccttgctttgtgtagaggttgacgcctttggtcataggtggactgtccggctgagttagccggaccgtttgtctgagcaccggattgtccgcacgtaggtgccggaccatctacgatgctggggctaggctgatgtgtttggtttattaactgtacctgccccccggcgtcttcggaccttttagccttctcgtccgaagcctttcgagcaatctccttttgtgatatatctgacatgcgaggattgctgatgacgatgcccttgcctttgtctttatcggccatttcgggccgaaccaagacctttttgcatgtgagttctattgtattaacaggaaagggttgtgtgtctacttgcatctcctgaaaagccaatcgaccctcatttatggccgattgtatctgtcgacgaaaaacattacaatcattggtagcatgagaaaaggaattatgccacttacaataagcacgcctctttaattcatcaggaggaggaatagtatgagttaatttaatgttgccgtttttcagtaactcgtcaaatattttatcgcatttgacaacattaaaagtaaacttaacttcgtcttgtcgattctttcgaatcgactgtaaagcagaacacgctgaaggtttagcctgtcctggccaaaccagttcggcggtgtatacatccgtggattcatcgtccgaattatcgtatcccactagatgcatcttatggctagccgattttgatgtttccttacttcggctttcacaggtcatagcccgctggtgtaagtgcactagtgaaaataattgggtgccatctaatttttcttttaagtagggtcgcaacccactgaaagctagccctgtcagttgtttttctgcgacatgaatctgaaagcatcggtttctagtgtcccggaatctccggatatagtcattaaccgattcttcaggcccctgtcggactgagctaagtcagccaattctaactcatgttctcctgagaagaagtgttcatgaaacttttgctctaattcttcccaagagttaatagagtttggtggcaaagctgcgtaccatgcaaatgcagtatcagtaagggacaacgagaataaacgaacacggtaggcttccccatcagccaattctcccaagtgtgctatgaattggcttatatgttcgtgtgtgcttttcccactttcaccagaaaacttagagaagtctggtattctagttccctgtgggtatggcacggtgtcgaatcggtgactataaggcttccgatacgattgccctgtacctgacacactaacaccgagtttgtccctgaacatcccggctacctcgtctctgaccctctctgccatgtctggcgaccatccattgagtttgtgggtggagatttcaggttgcctgacattactctgtcggctttcctcccaggtatgtttgaggtgtgtgttaggtgtcctattaatgtcaccagctcctgccctatacccctcaggctctcttgtggtcgaataatattcagccctatgtccatgaggtggtatggcatgattataatgtgttgctggtggggcaccataatgttgctgcgatgaatgtgggaactgtgcgtattgcgcagctctcggctctgcgtatgcatatccggacggtccggcgtaagaggccgaatggtccgcgacctggccaaatggtctgaaggtatatccggattgtccagccatatatggtgctacgtgggtagtctcgtacccagaccgtctgtcgtaaagaactggacgatccgcgatcgggccgaatggtccagggctgtacccggatggatcggccatatatggcgtgacttgggcagtttgcgcatggactcgtgtagagtcggatggtccagcgtaatacatcggccggttcatgccatatccggacggtccggcgtaagatggcggacggtccgcaacatatccggacggtccgacgtgatgtaccagacggtccgtgatggggccgaagtgtttaggggttgtaccctgatgatccggccatgtacggtgcgacctgagtgttttgtgtgcgggcctgcatctggtcggacggtccggcgaaatacgccggacggtccgcggtataaccggactgtctgagatgatgctcggacggtccggtcgcgtgcctagtggttgcggctgtgatggtgacacgaaagcgtgcatcgacataccatatgatggctaggtcaaaggtgacctgtttatagccgatgtgtttgacgtgggtggcactgtattagactctcgcgatggaaaattaggagcagctgatttctcgtatgcacgtaaatgcattttaatagattcatctacatattgctttaactgatctcctcgttgatccatgaaagttgtaagagatagatctggagtacttacagcgggaccctgcagtggaggtaggagagattccatatcgatctccccttgacggacgatcttctggtggcgatccatcgtgaagtgtgacaagtacttgtccgccgcctccttgcgccgttcggagagtttatgcagcagttccgcctcttccttgtcgcgttgttcgttccattgccgcatcacctccttctcatcgcgcattacgaggtcttcaaagggcctttggtcatcagccgggagcgcctccatggctggcttgatgatgttggtagtggagatcttggtgtgatccttagaaccgaccatttatgggccgatttttagcagatctagacacctattccccagcggagtcgccaaaaagtatgttgacgccttttcggagcgccaatcactcaagaagaaccggcggcggtgctctctggtcagccgcggacggtccgcggcctggggccggacggtccgcgacctggtgtgaggcggcggtgctccctggtcagacacggacggtccgcgacacagggccgaacggtccgcgacctggtgcaggagctcgggttccctgcctgacggccggacggtccgcgccctagggccggacggtccgcgcgtgcgcaggggcggcagaggatcgccggcggcgcctggatctcgctcccgggagggaccccgtcggggaggagagatcctaggagttgtctaggctcgggccggccgacctagactcccctaatcgacgtagagtcgaggagaggcagagaatttgaggattggaatactaaactagggctaaactagaactagactagaactactcctaatgcataaggtaaaaacgagtaatagacttgatttgttcgattgttgggggttcaatcggccgtagcccttcatctatataaagggggaggtctggatccgttttcaactgtttcccgagttaatcccgcggttttaggtaacaaatcccgcgagaaactaggaaccctaactgactctgcgcgcgcgcgaactgtccgcgtcaccaccgcggacagtccagaccgcggaccgtccggcctcggggccggaccgtccgcattgctctttttagagcttaacaaaaatgatattaacttgaatgaaaatcagactatatggatgggatggatctaggagggacaatgggttttagattttacgctataaaatttaagaataaaattagataggatgaaactctatttttatttattttgaactaaaattagtttagtgtcctaacaaattataaaaaaacctttagatcgtgatacattaccacgctctagatggatccgacccattttttaagatgaaaccatttctagcatcatttatttggtaatgggttcctgttgtttgcagttgggttcggaggactcgaaaatgacaatacctgacgtcagaccgtggctgccaccggcgctccgcggagcggccccgcccttggctccgcacttccgcagccggtaccaggatcgctcccttcgccggggcgcctccagggaggaggtcagtggtcaccggcgtggagcgcttcgcgtccagagagctccctccgccggggcggctctcgccggcgtttaattttgaaatgaaatgtgttactctcttatcgggctgtcagagtgaaactagagtttgggccaaacccatgagccatgggctgggcttcaaggagaggcaagcattacgggccggcctcacggcggtggcacttgagcagcaactacagtcaaccttcaagagataaccttagcacgttaacggcggcggcggtgagaaaaggcgggggagggggactggaggtgaaaggcggctgctttcgctgtctccccaccacccgcgcacagtggcggcgctgacggtggcaggaaaggaaaggtagagcatcagtcaccagcgcagcttctttcttttcccctttaccgccgttgtatttcggggggcggcattccttgcctcgctgctgtttcttgctctacggattcactggtggtggtggtggtggcggagctctccgtcctaggaggcgctggtggttttccggattgtttcgtctcgcccctcccctcttggtttgagcttgggttagcttcgtttagacggcctcctccacttgagctctttaacctagacgattggttagtgttcaatttgttgcctgttttattttttttggtttatctgattcggctagtttagctagatgttgatttgtttctgctatctcctttttttgggctatgtatttccgtccatgtcactttccccaatcgagttaccattactgggatggatgttctgtctctttagatttgatgtcataaactcattattatctgagcattcaaggcagtttatactggtaatttaatttgtaagattttcgtcgtcttgctgaggtagggttttgctcagagaccattatgctgtcacaagcttggggtgatgtgactgcacgtcatgtttgacgtggtttattgaatgatacatgcgcgtttgctgctgggcaataaatgttcagacggatttcctgagggaaatagcatgctggtttgattataatccccgagtttaacattcctttttgtgcctttccttttttttgttacagtggcgatcacaccaaactcacatacag

SEQ ID NO: 331 - DNA, 6317 bp, Zea mays
gatagcatagctgaacatgattccctgtgggatgcacaaaactgtttatgttacttgttaagtcacttatgtcaggcctctgatattgtgtttgatactctgtgtgccacttatgttcaatgtggctaatgtctatgctacttcgcatcagtttttatctgaagtgtgtcaaacataattgttaccagaatgtctatttatgttatctgttaacaaattctatgctgttttcatctgcagtttgtgagttggttaatctttttgcttccaatgtttggcttatttgtattatcatattgtttcaatattcaagttttatgcataatatatacttccttattttatatacactaggttcatcttttatccatttttcacgctaattatgctaattgtcaagtgtttatgctatatcctgtttgttatatttgaagtgtgaaaccgacgtatgcactcccatttgattagtattgttaagtgtatacagttttatataacattaatgtccagaccttccgattgctaaacgttcaatgccaatttgttgtgcatatttagttacataatttgtgtaattgtctatatttacgcaacattttatagttttatatcaacgaattatataaccctgtcatgcaaactatttaatttccaacaaactaaagcataagtcattgtgctattacaagtttttactaaatcgaccactctttagtcacacttcaaattattcgcccaaatccatatgctcatcgacttcttcattttccacttcttcatcaatacgatgtttttttgcagtcgatatttcattccactgtggagcagttgttttattgtttagtcttgatccggctggccgtcctctctttcgattagacagttttgctagccttgccctgttctcttccacagacagacatgttctgctgttatgcccatctgctattccacacaaatgacatctcctattcttctttttctctcctttcgcacctagtctcataatcctatcttctgaatttttgattgtccgaccctttggtcttgcacgatccggcatactcagatttataacatccacattaaaattcaacctctgcataataatagacgttactatttagtatacgcatatttacatatatttataccaatcagtaaaatcatttatcaatgctcacctttttagcttctgaggatgcagcaatatgttccatttgttcatgtgctacgtgacacggagaacttgtatcaccaacctcatgtgaaattctcatgttgtcctcctttaaagcccaacccaaatacatcaacatttacatgcatcataaatatatattttcattttagacaaataaacaatattattttaatatgtacctggttaccagttgttattattgttaacgcgtgttcacatccagtcctggtgttatgcgaatcctacaaaatattatttgcttattacattgatattatatattcattatatacaatacttcatgcaagcttatatatatatcttttacataccttattatgacatgtaattgtattgtcatcttccatctcatcgccagcattatttttattcaactcttcttcctggtacaaaataacatgttactatgcataatttatgttacaaatagtataacactaaaacatctgcaatattattaccttgtcttcctcattatcactaacatttgttgactcattacatccaatatctggctccaatcggcttagaacgacatcgagttcatccaacacatacattgccttatcgtaccctgcttttgacatacacgcctgacgaactactttcattgttttcgttaacaacattttctgtctgtatgatttagtaactccatccttccccctgaagctcttatcaattctttcaaacggaacatcttttcttgatgagacagtgtacctttgcaatatatactttgaaggaatcttttgaacttgtagatgcatgaaggctcttaaaatatgaacacacaatagacctgaaaacatgaaaacgaaccattatttcaaaaatatacattaatttgtactacaatcatcaaattctatattttgcaaatttttatgctaaccaacataatacgtacaaacttgtatgttcccactgtttgcactcgcatgtatactccccagcttctatgtctgctgttatcttgaattgatgttgtccccacacaattttattagaccgttttgtatgctgtacgatccattcattatcacatccgtctgggtcctttaatattttgtatgcagtggcgtatttcattgattcctcgaatctattcataacagctctggtgtatgctcttgagactctcacttcgaacctatataatgtatctgttgtccttggtgtctataacacattattatcataattaaacaaattatttacataattgtatgcaaaccgttattgctaacaagcacgacataccttgctcaccaatgcctcctttgattctttcattttcctgttgtgcaacattttcatcatttgtttagcgaactcatgcagtggggtgttcgcatctacatgtgattgcttcactaatctgttcatgctctcacttcgttgtgtagataccattaccccacagaagtcatttttaaaaaatgcaggtatccattcttttcttatttcatataatttgcgtagggtcatatcttcatgaagattgaactcctctagcatcatttcccaggcacattcaaactcatgaagagttaatggatgatgtataatagactggaatgttgttttaaaatccttaacaacaaacctggcatatatctcattcaggaatggcataaatctgttctgtacatgccataagcacagtctgtgaattgtttttggaaatacagttctcagagcaattggcattgcaggatcttgatctgcaattgttcacagattattcagttattttcacaataaattaattcactgttttgcataacaaatttatatatcacatacctgtaagcataactcttggaccctcgcatcccatacatgttttgaatgaattgaaagcccattcaaaagtatgtacagtttcatctcccaacaaaacaaatccaaacactgtacactgcagatggctgttagctccaacaaacatgcccagtggtttatcatatatatttgtcttgtgtgttgtatcaaatgtcacagcatcaccataatctgcgtatcccccctgcatacttgcgtgtgaccaaaaaatactaactattttcccatcatcgtctagctggaaatcacaaaaaattgtggattctgtttcttgcattctctaaagaaagccaaaagtttgactacatcatttgagcaattttctcttctcctggctgccctcctacatttgtttgcacaaaaaaatgttacacacacatttactatagtaatattcctggctattgatatatacacatgtaacaaaaaagtattgcttacatgtttttcagatcttgagcagttaccggtacgttctccggcccatcatgcatttctgatatgaaatcaactatgcaatgctgcggcactcggctatcatgcattgcatccacaaaatttatgaacttagcatccctaattttgttgcaacgtaaatgttgtttctctgcttcgtcagttatgaactcatggttatgctccaagtttaccagttcaatttttgtagctacaaccattttgttttcatcatcatttttttaattttattccagctttgcattgtgtacgtcccgatgatctattcctcatcctaggtgtatcattagattttgctgcacttttaccttcacgtgaacaatttatccacttactgaatgtcttctctctgtatttcttcagtggaaatccaacttcatatgcataccttttatagaatttatatacatcatcaacatccttgaaagtcatccctaccgttggcactatagttggatcaatgttttttgcctgctatttcattgtcattgttgtttgtaccatggaatatgttcacaacaatataatcaatcaataatcaaatacatcgattggacttacatgtgaacgcattatctatggcgtatccatctccctggagctaatattggacataggaggtcgaaccctttgttctccttcttcccctatgctcatctcggcgatctcaggacccattagagcaggcggtggtgtcaccagtgagttaccaccaactcctccctctgtctctggatctagacgaacgccatctccttccatcgccggcgaccctccagagccggccatctccaactccgattagttatgcaggcatagtggttttttttccgaatgaaagtaaatctcggatgctataaaagtaaccgcatccacgtttacagggtctccccattatttccgaaaccgtcccgatattatggcgacgtctttgtcaaactaaaattcataatataaaatttacgcacaatgacacaacgttttacgccaatcggtatataatgtttatgcatctattatgccgcttcggttttatgccatatctttcaacatcttatgcttcatgtttttttaccttccgcacattacttaccatgcaagatccataatttacgcgcccacgtatcccagtaatcacgtttgcatgtggcatatattccctttaattccgcgcaattcccttaccattcaaacaaccgcgtcacggcgccgtctgtcctgcatgccgcctcttagccccacgttaaaacacaggcgcgcctgttccatcggccagacctcgggaaccgacctgggcttcctttaatatccgaagcccagagctcccgttatacctgccctatatatatatcatttcctcctgcctggtttgtataggcatggaggcatggaccgtcaaaatatgcaattgtcttctgctagggaagacatgcataatccgcaggtttatgtggttgtcttccttttagggttgcatcccatacatttgactagaggttagtggtgcttatgtaggatcgtcaaaatacgcaattggcttctattacttctacattcgtttgactttaatctatacctgcagttgcagcagtacaaacaatcagttttaattcgaagcgaacaaccctatacttcccgatcctgttgtacatatacgagaatcggagcgaaagcatttttagcgctacggaagagattcttgtcattcctgttgagggccttcgtatttcgaaggtcctcaaaaacacgactaacatgctttccaagtataatacattcacagggaccttcggccttggaatgaagctgtacacgatatgaaaaacgtggtctgggagaaggatgaaccagttccgaagctgcgcgtggagaaacttcggcttagcggtggaaaatgaaaccggcttaaagaggaaaagactatctagtcctcgatagattgtccgtaagtcaatagtaaatatcaaggtcatgaatgtaattttacacaggctgcgtcctgtgcctataaatagatgaacagtggcaccgtactgtttacgctgacttgtattcactcgcacgtcactcttgggctcataccttctgtcaaaccgaaggtacaaatgtaatttactgttattaatgtttgtccatgataagataatgagaatataaataatctgtcgattcaatatgattgttcattttattctccatgtttcatatgtttctaccttcattatcacgtactgagacgatgaaggtatgtctttcaaaaccttcgtctgaagatcattatatactaaggggataatgtttcgaaggacgaatgtttttaattattaacattttgtattaccttatttttaactcatatcatttgagaaaaagtccccatcaattcccatcccacgacaagaggaaaagactcactcgcgctcatacaacttctgatctatattcttctttttagccactcgcaaaagcgcacgtgtgttgcaccgcgttattagctttcaagttgtcttttgctcgagtggtagacgatgtgtgtgatggtaaacccaacggacggacgacaggcccggtcctttcccaggtgtgggcttccaaatgcagggaaatccgtggctgagttacacgcgggcttctgctatggggaaaggccgggacattcacggcaaacaaggcccagcaaacttcttaattctctgacctggatcggacggcgagggtgtcgcttctcctgatccaatggcgctaccggactcgcacgccacattat

SEQ ID NO: 332 - DNA, 10000 bp, Zea mays
tctctggttccaagaatctttgcctctctatatggtaataactccttttgtcctcttttcctgtttactttgactcaggggcagtgctttcattctcacggtcggtccttttgactgagcggctggactagtttcttctgtagcttattccaggcttcaagggtaagcttcccggtatcttcttgggtaaggtgcttttctcttgagatgggttaagatgagaatggaagcataaggtaaggattagctctaatttgtgatctatgtttttagagaaaacctttcttaaaaagaaagaaaacacacaagctcagcaatgataagcacaaacaaatcaattgttttgaataagggaagaatagagtttttccaaagcacagactactcatattcgggggctaagcataactactattgctcgactcctgaaatgagaactatgctaaccaggacttatgagcactaacgtttaagcatcacatatgcactcaaaaggggagaaaacatcaagcgaaattcattttgaaatgccctaggggcccacacaattagagttttgcaaaacacgagtctacatgattacctctcaaacatgcagggttctagccaaagtgaagaaaaacttcactacccaatgcatgaagaggaccggtcataactaactttagaccaggcagcttctcttctggcaaggctggcacacaacttcaatctgagacatctcctgaatgggtcaagtgggagctgatgttgatgacttcttctggcggcgactgatatggcaagacggggtcgaactcttcttcaagctggactggctcttgtagctcctcagagggcagcggtgctggtggggtgcttgcaacttcttctttgatctcacgggaaggtgctggaatcttcttcatggtgaggggctcaaacaactccggcgggggatcttgggaggactcggggtgctcttgcttattcatagcctgagggaagactggaattccttccaagactatggctccttccgggagttcccaagccttcttctctcctctgatagagaccgggtgaccttcaagaatctgggggtcttcagctctgatgggttgaacagggttggatgaagcgggctcttggatccgcagggctctacattggttatgggttaccaagtaggcctccatcaacttctggacgtgctcatccttggcttgcttcagggcttcaacagcaatgacttcacgactttccaaggcagctacacgagattgagctgtggtgagatccacatggagctgacggttgcgcttctctgcatcttctgctcgggcaatcatctgacggtggtgccgagccaagaaatcatactgtgcatccagggtgagcaggtatgcagtgaggtacacgactgaggggtcgtcctcaagcagctgctgctcttccaatgcacgcatcttggccatccaaactggacggtttctctgaaagggcggaaagaatctgagcggtgtatcggccacttcttcttcatagatctgacacagggccctcaatgccttacgagcgacgacttggtaggtgtctttcaatctgtgcccataagcagtgacactccattccacatggtgcggactggatccaatgtatacagtcacgacacatttctctgtgccatgctcgacgaattcacgactatcatactctggctggctcctgattccgaggcgaactgtgcatgctttcagcaacttggggaaaccatcttcattctagcaaaagctggtttggcaacggacctccatttgacttctgagagaaggaaagggggaaaacatttttaaaatgaagggatgagagcaagatttttataagataatagttttgactcaaaaacttttggatcgggctaagggttacgtcctgcggccaacctaacagctctgataccacctgaagcgccccaatcctctgggactcaaatgtgatacaattactagcccaggaggctagtaaacacatttatacatcagatgattatagatctgcttaaatgagacaaacctataaaggtggcgatcaactttaagagttggtccacaactcgggacatatcatcagagtggggctgaagcagcccgatatacgcagcgaagcaaatctgcggtccaacagccacatgcaaggttgggaacagtcgtaactcttacccgatctcctttttctgaaaaacaacaaataagcaagggtgagtacaaatgtactcagcagcccaccttcacccgcggaatggggaaatcagatataatgcatggaatatctggagctcagaatattttgcagaaacaacaatattttatgcagggttgttttgtaaaacattttgtattttgcaaagcgcatcctctcccaaaggagcaggaagtttttcaatatggaacaaaatcccctggactaaaccatccaggtatctcagcagtttcccactagttttcattttcaacaacagctactggacttcccgtccaccatagctcacggcttaaccgccggaccttttaaaaaccatttttctcaaacacacccttttttgaaaacaaaacattaattgccataccataccagactcgtccattcccatggacacggactattcgaataggttttcaaactctgcgtagaggtgtacactttacccactagtgcggtttctgcgatctcaccgtcgtgagacccgaatgccgaatctctttctttcctcgcacgtcctaaccttaacggttataccggaaggagtcaggccaccgccatgtccaaaccggacacaacattccccctccttatcctcccggtgctccccagccttcataaccctggggttggaccgtacgagttcagattgagtgactgcccacacagtctcgagtggttgtacttatcatgagtacaggtagtgaaggatgacaaactagtccttatgtgaggggacaatccttctgctcacacctaaaccagctgagccatcaccttaggccctcccctaaaccagggagtccctgatcatccctactcaaaggtgataagggtgaaaacccttcatcatacacattttgaaaagcattttcttttgaaaactcacacctttcctcaaatcatttgtaacaaatatatcagggattgatcgcggcaagcggctgggtggccataataacttgtctcaaaatcatatcatgcataaaataacaggctgatggttgtggttgaaaaacataggtaatttatgcatcaacgggatccagtgagcttgtcgtgcttatccggcgaagggggaagaggagctcgcagaactggcttgtccactgcctggcgtagacttgcagatctggcctccacgagacggcacgaacactccgataactatgcaacatgaacaagcaaacatacaaaccaacaagtataccaacaaatatttagtatagtggtcagaatagtgatatatagatgggtagagtcttgagtagaatctgtgtcatgtggtgttgagatactgctggtggtggagcgaaggtgcttaccaggagggtggactggagacgaagcgacactatgtgtgtagccggcagagcggagtaactaagtgggtggggtgtttgccttggctgagggtgttgagtgtgtggagtgggagagggtagctgggtgtatttatagctgagtgtatgtggtgtagcacagtgaagttcactgttggtgagaatagtgacgaatgaatcgcctgacttaatatgaacaggagagttataggcagaatatgggacaagagtattttgggagttttctggaatatgaaccatgcttaagggatcacatggttggatagggaatagtttgacaagaattttagtaacaagaatgactgaaatctgagtttggatggaggagttttggattttataatcatagggagaaaaagaaaaggaatattctagaatttgaatatttagagatatttggaaaatcaaaaatacaaatgtatttttgagcggggtgcgaggaattatttttgggcttttcttgggcagaggtttatgttggtggaaaatgttcctacctactgtgtcacatcagacagcagtgaggcgggacccgaatagctggaatgctgtggtattctggtccgagtgggctgtggtatcttgagccaagttttataggattgaagacgtatccatacaaacatggtttgcctttctttttggaagtctggcttgaaagaatcccaaagttaagcgtgctcaacttggagaaatctgggatgggtgaccagatgggaagttccctactggaataaaaaacacagtcaccggagttcgtatgactggaatatgggtctggctggtcttaggtggattggatagcatgatggatgagtagttgaaatttagggcgatcggatgatcgatgaatagtaatggtgaatagtaacagtgaacagtgatggtggatagttcgtatgaacgaacgatgaacggtgaatagtgacgatgaacgatgaataggaactatgaacgcacgatgaacgatcgaatgatcgaacgaacgaacgatcggaatttcggcagcataacagcaggaaaaatattatttggacgaacaaacggacgaacgaaccatgaacgatcggacgaatgatcggacgaacgaacgaacaaactaagaacaggggggacgaacgaccgaagaacgaccgaacgatccttgtgctagtgggtgcttgtgtgggaggtggagtgggagtgggcgtgtggggggggagggagttgccatgaaatggcttggggtgggatgagaggaggcccttgcccctctatttatagccatggtggggggattagggggagggatgagaggattagtgggaggatgagaggattagtgggagattagcatggatttgtcttatatgagtgtaattagcttgtagagctcaccgtatgacaccggaggcatacgtatacgtatgggcatgaggaaagttatgaagaaaatatttgtagggacttgaaaaatgattctgaaggtatttctcaagaggaaaatacttggagatatatcggtggaatatctaggcaatatttctggaaagaacttgaaggggatcactagggaaatatcttggcagtatttctagaaagaatttgagggcgttcactagggaaatatttgtaggatattttgaggaggattttggagagaatatagaccactatatgttatttgctgatatcaactcgcaaacaaacattttggaatgaagtttgaaattcattttgaatttagagcgagtttgagaaaatttcatgatttgaatttttgggatgctacactgcctgcctcgccacgccacgcccgagcccggcccggccggcggcagcgagcgtgcgcgtgtggcacacccttgtccgtttctttacttctcaaattaagtagaataattcccaccatataagtcaagccaacgacccttagacttccaatatggtactattggtattctccaccattacacaccatagagtttattgaataaatgggccaagcccataaaagatccaacaatccccaccaaactctagggtttgtaatgatgaagtatcagaatcacaatcctttgatataccagtgtttcgatggaaactgttaagttgaacatccatctagaataagagtttcacttattcacaactaaacaatgtgtaaataccatcctgccttacagataggaaagatgtgcatcagaaatgagttaaggaagggatctttcctcacaacctactcctagcttgtttctccactctacttcacgggatctccgatcacatagagcaggttaccactagagtagatttcacatgggtctcatacccatttctctcgatgcactttctatcacattgcgtgacatacccttagtgaattgatctgccagattattcgatgtgtggacataatccaccgttataactccggagtttttcagctttctgacagattccaatctcctcttaacatgccttgtagacttcatgttattcctagaactgttaacctttgtaatcaccgtttggttgtcacagttcatggaaatagccggtatcggtttttcaactaccggtaaatccaataggaaatcacgaaggcactcggcctcagccccaacactgtctaatgttgcgagttatgcttccattgtagacttcgttaagatagtctgcttgcgagtgtggcacgccacgccacgcccgagcccggcccgctggcgccagcggcggcgcgcgcgcttgtggcactcccttgtccgtttcttgacttctcaaattaagtggaataattcccaccatataagtcaagccaacgacccttggacttctaatatggtactattggtattctccaccattatacaccatagagtttattgaataaatgggccaagcccataaaagatccaacatccagctcagtctcctctccctattcgacactgcattgttaatggtgtcaggctttgccgaacgtgcgtcatggtcatgggggtcgcgagagcccgaattttatactccccaagggagagtccggccgacgggccgagcatcgatcggtgggaggatcttccggaatcgcgctaaccgaattctgtttgtaacaaactcgaggtgaatgacaatcctgacagggcagtcccacatggtggtgacagcaacgatgcaggcgttgaagatacaagcgcgcggagaccgacaccgcgggcccgcttgtcagcaccgcgacgagttccgggctggcaggagttgggtcgaatggtgagatgggtcggctaggaggcaaggagaaggcccaagtgtgcagtgaggtactcttttttccttttttctattttattttcagttttctattatttcctaaattcaaatagagttttgaattccagattaaatcctgagtgtaagtatctatctttgatttagatgcacagacaatacttcggcatgagtgcaaggttcatttttaatctattattaattatcctagttaaggaaatgtttttagatatgcaattcatacatcccaaactagatattttaagaaaagattatttctagtgtataaaatactttagagagtacttataaatatatatgtttcgacaaaagaataactaaattcatatatgtatacttttattaaatatttttttctccaaaaaaccatgtttgttttataagaagtgtaagaaaatcattttaaagaaatttttaagtccatttaaaagaaactttttaatttcggtatttggagaagttttcataaatcccaaaattggattttgaggtgttacaagaacaaaacaccatcaacattttgcactggacgttggacatggtaaaagagtatttcttttcctttttgcaattttattattttgattttgaaggacgcttacggccactatgaagatgaagtggtccaaagggttcgagatctagaaagcgacggattactactattgtgacgacttgatcgattctatgttcatgttgattttaagtggaattaaaaaacttttcaaaataattttataagaagtgttaaaattttctacgtgagcctttaaaatagaattaaaattttctttaaaataattttataattttcttaccctttagaccaaaaatttgattttgaggtgttaaaagggaaatatgaaggatttttaaaggaatcatatcctacaggaaaattttctacgtgagcctttggatcacaagattcaatcccattaattcctttgaaatttctatagattgctttcttccgtacaagttttggaggaaaaataacaagcggcccaacctcttgtaaactttcctatgattcttatctatctattcaagttcatacatagcatccaaaggccatgcaagaattttttctgcgtactcaaatcatataggattatgattcataaccaactctaatcatgtgcttttcttgttcctgtgttttcatattcttgtgttccaaaggaggctttatctttgtagaatttttatgtattttgtgctcacaatgtctttgggtcctgtttgatatggcaccaactccatagatttttgattcactccacaactccagatggagagttggagttgcatgggaggctagcaattaaaaagaagtttttacaggtgatatgacattcttgccaagttcaacggggttagtggcgcgaccgcacgtggccagtgatgccggcacacatggcacagtcgacgcaacggggctaggggcacgaccatgcgtggccccaggcggtgcaactacgcacgactggtgcgtgggagagcgcatggccgatggtggctcaggcttgcaaggggacgggtgatggggcctgggggcgcacgatcaatggtggaccgagagctcaaggtcacggacgacagggcaaagagcctgtttggtttagctttttttctaaccatctttttctgagaatctggctatgaagagaacctagttgtgggaagaatctaggtatcatggggattacgtgcggataaagatgaagtagtccaaagggttcgagatctagaaagcgacggattactactatcgtgacgactcgatcgattctgtgttgtcatgttgattttgaaccgtttttaccaaaacgattcttatagaaacgggctgaaaagctagggcatttggcagtccgcaacagcttttgatatccagaagatgaaaaaagcccaaacaaatagggtcgaaggcggaagcacgagagcgagtagaggatgctgagagaaaacacgattcgattgataggatacaagggaaaatataaatgattttttatttgatagcattgatgagtaaataccaccgaattggtttgaagttgaaaaactccatatccaaatgaactagttacatcaactctatcaagttagtctgctcaaaaaaggtggagtttggatgtttggcaggttccactaaattattgcctagagattggtgttgtaaccatgctaagcaagtcctttgtgggcacacaggttcgacaacatcgagctgctccccttttttctcatcggaggttttttatctttagaactgcttataccatctctaacagttcattcaaagtttactcataaacactattttgcaatgttctgcactgtagactgcattgttcgcggagtgaagtttaaatatgattatggatgtaggtaagcttattggagatagtcttagagcatcttcaacaaggtggctcatcatagtaccctaaaaattaaaacactacatcatttaaagtgtttaggatactaaaaacaaaatgcgctccaacaattaagcactaaatcatgtatttttggaagtgaattacattatttggaaagaaaatattgagaataatgtagaaaacaaatatagtgcactagcgtgggtgtagtatatttgagtcactttatgaagtgtcatatattttataataaaaatttacaaaatagagtattgttggaattatttttttatgaattgtgctttatatctgacactccttatcttattctctatttaaaacttcgctttataagtaatatagtctacaataaaaaaaacacttagcacctatttagcggtgattgcctcaggaaatactagcaacacggaaccacaccgagccttgcatcgagattcacgtgcgactagggtagggaccatttgtgctgttaaatcaggcttgcgctgttgattggacccggcccatagtgccctgtaacttgctcggcccactagggttttggggtggcatataaaagctgccctcgcgacctagcaccagcccagccactccactcctaccccacacagaagcggcggcggcggagcaaacgcaggcgaaggcgagggtgtgagggaaggagcaccagcc

SEQ ID NO: 333 - DNA, 10000 bp, Zea mays
ttccggcttcgcaaaggggaggagccacaacacatgtacaaccggctcaagaccttggtgaatcaagtacgcaacctcgggagcgtaaagtgggatgaccacgagatggttaaggttattctaagatctcttattttccttaaccctactcaagttcaattaatccgtggtaatcctagatatactaaaatgaccccgaggaagttatcgggaattttgtgagttttgagtgcatgatcgaaggctcggggaagatcaacgagcttgatgatgccaccacatccgaagctcaacccgttgcattcaaggcaacggaggagaagaaggaggagtctacaccaagttgacaaccaatagacgcctccaagctcgacaatgaggaaatggcgctcatcatcaagagcttccgccaaatcctcaagcaaaggagggggaaggattacaagtcccgctccaagaaggtttgctacaagtgtggtaagcccggtcattttattgctaaatgtcctatatctagtgacagtgaccgaggtgacgacaagaagggcaagaggagagaaaagaaaaggtactacaagaagaagggcggtgatgctcatgtttgtcgggagtgggactccgacgaaagctcaagcgattcctcctccgacgaggacgccgccaacatcgccgtcaccaagggactcctcttccccaacgtcggccacaagtgcctcatggcaaaggacggcaaaaagaagaaggttaaatctaactcctccactaaatatgagtcttctagtgatgataatgctagtagtgaggaagataatttgcgaactctttttgccaaccttaacatggaacaaaaggagaaattaaatgaactaattagtgccatccatgagaaggatgatctcttggactcccaagaggacttcctaatcaaggaaaataagaaacatgttaaggttaaaaatgcttacgctttacaagttgaaaaatgtgaaaatttatctagtgagctaagcacttgccgtgagataattgacaaccttagaaatgaaaatgctagtttaaatgctaaggttgattctcatgtttgtaatgtttcaattcccaatcctagagataataatgataatttgcttgctaggattgaagaattaaacatttctcttgctagccttagattagagaatgaaaatttgattgctaaggctaaagattttgatttttgcaatgctaccatttccgaccttagaactaagaatgaaatgttgcatgctaaggttgtagaacttaaatcttgcaaaccctctacatctaatgttgagcatgttactatttgtactagatgtagaaatgttgatattgatgctattcatgatcatatggctttaattaaacaacaaaatgatcacatagcaaaactagatgctaaaattgccgagcataacttagaaaatgaaaaatttaaaattgctagaagtatgctctataatgggagacgccctggcatcaaggatggcattggcttccaaaagggagacaatgtcaaacttaatgcccctcctaagaacttgtctaactttgttaagggcaaggctcccatgcctcaggataacgagggctacattttgtaccctaccggttatcccgagagcaaaattaggaaaattcattctaggaagtctcactctggccctaatcatgcttttatgtataagggtgagacatctagctctaggcatccaacccgtgccaagttgcctagaaagaaaactcctattgcatcaaatgatcatgctatttcatttaaaacttttgatgcttcttatgtgcttacaagcaaatccggcaaggtagttgccaaatttgttgggggcaaacacaagggatcaaagacttgtgtttgggtacccaaagttcttgtttctaatgccaaaggacccaaaacagtttgggtacctaaagtcaagaactaaatttgttttgtaggtttatgcatccgggggctcaagttggatactcgacagcgggtgcacaaaccacatgaccggggagaaaaggatgttctcctcatatgagaaaaaccaagatccccaacgagctatcacattcggggatggaaatcaaggtttggtcaaaggtttgggtaaaattgctatatctcctgaccattctatttccaatgtttttcttgtagattctttagattacaacttgctttctgtttcccaattatgtcaaatgggctacaactgtctttttactgatgtaggtgtcactgtctttagaagaagtgatgattcaatagcatttaagggtgtgttagagggtcagctatacttagtagattttgatagagctgagctcgacacatgcttaattgctaagactaacatgggttggctctggcaccgccgactagcccatgttgggatgaagaatcttcataagcttctaaagggagagcacattttaggattaacaaatgttcattttgagatagacaggatttgtagcgcatgccaggcggggaagcaagttggagtccatcatccacacaagaacatcatgacgaccgacaggccgcttaagctactccacatggatctattcggcccgattgcttacataagcatcagcgggagtaagtattgtcttgtaatagtggatgattattctcgcttcacttgggtattctttttacaggaaaaatctcaaacccaagagactttaaagggattcttgagacgggctcaaaatgagttcggcttaaggatcaagaaaataagaagcgacaacgggacggagttcaagaactctcaaattgaaggcttccttgaggaggagggcatcaagcatgagttctcttctccctacacacctcaacaaaatggtgtagtggagaggaagaatcgaactctattggacatggcaagaaccatgcttgatgagtacaagacaccggaccagttttgggccgaagcggtcaacaccgcctgctacgccatcaatcggttatatcttcaccgaatcctcaagaagacatcctatgaactcctaaccggtaaaaagcccaacatttcatactttagagtttttggtagcaaatgctttattcttgttaaaagaggtagaaaatctaaatttgctcctaaaactgtagaaggctttttacttggttatgactcaaacacaagggcatatagggtctttaacaagtccactggactagttgaagtctcatgtgacgttgtgtttgatgaaactaacggctctcaagtagagcaagttgatcttgatgaaataggtaatgaagaggctccgtgcatcgcgctaaggaacatgtccattggggatgtgtgtcctagggaatccgaagagcctccaagtgcacaagatcaaccgtcctcctccatgcaagcatctccaccaactcaaaatgaggatgaagctcaagttgatgaagggcaaaatcaagaagatcagccacctcaagatgatggcaatgatcaagggggagatgcaattgatcaagaaaaggaggatgaggaagaaccaaggccgccacacccaagagtccaccaagcaatacaaagagatcaccccgtcgacaccatcctcggcgacattcataagggggtaactactcgatctcgggttgcacatttctgtgagcattactcttttgtttcctctattgagccacacagggtggaggaagcacttcaagattcggattgggtggtggcgatgcaagaggagctcaacaacttcactaggaatgaggtatggcatttagttccacgtcctaaccaaaatgttgtaggaaccaaatgggtcttccgcaacaagcaagatgagcatggtgtggtgacaaggaacaaagcacgacttgtggccaagggatattcccaagtcgaaggtttggatttcggtgaaacctatgcacccgtagctaggcttgagtcaattcgcatattattggcctatgctacttaccatggctttaagctttatcaaatggacgtgaaaagtgccttcctcaacggaccaatcaaggaagaggtctatgttgagcaacctcccggctttgaagacagtgagtaccctaaccatgtctataggctctctaaggcgctttatgggctcaaacaagccccaagagcatggtatgaatgccttagagatttccttattgctaatggcttcaatgtcggaaaagccgatcctacactctttactaaaactcttgaaaatgacttgtttgtttgccaaatttatgttgctgatattatatttgggtctactaacgagtctacatgtgaagagtttagtaggatcatgacacataaatttgagatgtctatgatgggggagttgaagtatttcttaggattccaagtaaagcaactccaagagggcaccttcattagccaaacgaagtacactcaagacatcctaagcaagtttggaatgaaggatgccaagcccatcaagacacccatgggaaccaatgggcatctcgacctcgacacgggaggtaagtccgtggatcaaaaggtataccggtcgatgattggttcattgctttatttatgtgcatctcgaccggacattatgctttccgtttgcatgtgtgcaagatttccaatccgaccctaaggaatcccaccttacggccgtaaaacgaatcttgagatacttggcttatacccctaagtttgggctttggtaccctcggggatccacttttgatttaattggttattcggatgcccgattgggcgggggtgtaaaatcaataggaagagcacatcggggacctgccagttcttgggaagatccttggtgtcttgggcttcaaagaagcaaaatttggtcgctctttccaccgccgaagccgagtacattgccgcaggccattgttgcgcgcaactactttggatgaggcaaaccctgcgggactacggttacaaattaaccaaagtccctttgctatgtgacaatgagagtgcaattaaaatggccgacaatcccgtcgagcatagccgcactaagcacatagccattcggtatcattttcttagggatcaccaacaaaagggagatatcgagatttcttacattaatactaaagatcaattagccgatatctttaccaagccacttgatgaacaatcttttaccagacttaggcatgagctcaatattcttgattctagaaatttcttttgctagcttgcacacatagctcataaatgtacctttgatcatatctctttcatatgctatgactaatgtgtttttcaagtgtatttcaaaccaagtcataggtgtattgaaaggaaattggagtcttcggcgaagacaaaggcttccactccgtaactcatccttcgccatcgctccaagaaaaggaccttatttttggggagtaagcaagagcccaaaggaccggacttcgtctttggtataatcttaactcatttaattatgaccaaaggggaagatagtacttcaatgggctctaatgattccgtttttggcgattcatgccaaagggggagaaagtatgagcccaaagcaaaaggaccgcaccaccaccaatttcaaaaacttagtgctttccaagagtatttatcaaatggtatcctattatgttcaaaaggggggagaaagtagtatttcaaaatgatatatcaaaaccctcttgaacactaagaggtggatcttctttagggggagttttgtttagacaaaggaaaagcatttaaaacagggggagaaaatttcaaatcttgaaaatgctttgcaaactcttattcatttacctttgactatttgcaaaagatctttgaaatggatttacaaaagaatttgcaaaaacaaaacatgtggtgtaaaagtggtccaaaatgttaaaaataaaagaaacaatccatgcatatcttgtaagtatttaatattggctcaattccaagcaacctttacacttacgttatgtaaactagttcaattatgcacttctatatttgctttggtttgtgttggcatcaatcaccaaaaagggggagattgaaagggaattaggcttacacctagtccctaattaattttggtggttgaattgcccaacacaaataattggactaactagcttgcccaagtgtatagattatacaggtgtaaaaggttcacactcagccaataaaaagaccaagttttggattcaacaaaggagcaaaggggcaaccgaaggcacccctggtctggcgcaccggactgtccggtgtgccaccggacatgtccggtgcaccagggggactcaaactcaaactcgccaccttcgggaattttcagaggcgactcgactataattcaccggactgtccggtgtacaccggacagtgtctggtgcaccaagggaggtcggtctcaggaactcgccagcttcgggaaactccaacggctagtccactataattcaccggactgtccggtgtgcaccggactgtccggtgcgtctccggagcaacagctatgtccgcgccaacggctctctgcggtgcaataaatgcgcgcgcagcgcgcgcagatgtcaggcgcgcccatgctggcacaccggacatcaaacagtacctgtccggtgtgcaccggacacccaggcgggcccacaagtcagaagctccaacggtcagaatccaacggcagtgatgacgtggcagggggcaccggactgtccggtgtgcaccggactgtccggtgcgccatcgagcagacagcctcccaacggccacttttggtggttggggctataaatatcccaaccaccccaccattcattgcatccaagttttccacttcccaactactacaagagatctagcattcaattctagacacactaaagagatcaaatcctctccaattccacacaaagccctagcaactagtgagagtgatttgtcgtgttcatttgagctcttgcgcttggattgcttcttttctttcttgttcttgtgatcaaaactccattgtaatcaaggcaagaggcaccaattgtgtggtggcccttgcggggaagttttgttcccggctttgatttgagaagagaagctcactcggtccgagggaccgtttgagagagggaagggttgaaagagacccggcctttgtggcctcctcaatggggagtaggtttgagagaaccgaacctcgggaaaacaaatccgtgtgtcacacttcattatttgctcgcgatttgttttgtgccctctcttgcggactcgtttatattcctaacgctaacccggcttgtagttgtgtttatatttgtaaatttcagtttcgccctattcaccccccctctaggcgactatcagctaccgtcgcccacatccgtcgccctcgccacaggggtcataactatatcgtgtctaactaagttgttcaaccatatcttcggtcgaataagatgcttgacaaatggacgagaaggtactgatctacaagaataagagagatgcaaagttgtaataactatcaggtgattaatttgatgagccatactgtaaaggtatgaaaaagagttatcaagcatcgtttggtagaataattgagggtgttttgggtcattttggtttcatgcttgtaaggtcagccatgaaagccattttttaacaagacatgtgatggagcagcatggggaacgaaagaaacatctacacatggttttcattagattgtagaatgtcgatgataaaatactaacgaacgttatgtattgggctttgaacaaacacaatgttcgaaagaagtatgttggactaactaagaacatagcccacatctagtcgccctcctcctccgtttgtgcatacttcaccataccaagtaaaagaagatggtgactagttggttaaggtttgtttgtgatacacatattattatggggaatactttgcatgttaaaaaacttgtatgacaaataatttgcatgcaattagcccttgaacgtgcatctagtcgctaagtgttattttggtggattgaacgttaagacaattaaagggcctaatgtgttctatgggattgtaggtgtctggttccatgtgagttgaattaatttgggttcagatgtagcaaatggcatacagatgagaaactagcccaaaccatcttgaaagaatgaattgacaagcttatgttcatcgtttacaaataagatatgggagtttgcatgcagaatggtgtcactcttgaatcttgatcaaccaaaatgaagattgacattcgtaatagcgaagacaacaatatagatgaaattggtatatttattgtgtttaatggttgattcaagacgtgactccatggcgtgagatggtaaacataaaaggagagtcttcaaagtactaagcaatcatgaagggcaagcgacgacttgacatatgacaagagctactggttgtgaaacatgaagggtaaacataaaaggagagtcttcatgccctatcttgtgtacaccgtcgtgacactaccaggcactagatacgaatcaagcacgtgccaagcaaaacaacccacaaccgaccccaacatttaaacaagttcactagaatattcgccgagtaagccatataacgagagctactgattgtcaaatactttaattagacctactagttgctaggaggtataaatagactcataatattgtttgtgtatcatgtatgtttttttgggtcatcaattttgaaccaacaacctttatatcttacatctacattattcactatttcgaacactactttataaatattatcgtttacaatgcaaaatattattttaattacacgaccatatcaactagtgtgaaatatatcgtcattgattggtaccggctacagtgtcaccacatcgggcccaagtgtgtgcagcaaatcgtgtacataatgtgtaaaaaattatatcggtaggttgtattgtttattgaataaagttttaaaaggtgtgacatagaatctgatgaaagcatcattaccgtggtactacatctgttaaaaaacatacgacgccgtcttattaaaaatcatgctttatcgtttattttatgatttgttttataatttaaggttaattgagtgtggctaaaaaattatactctgaataaatatttataataataggaatgattaaagttttgaaaaaacaacgcctcgaactgagagattagcatcataggctcgtagcaacggccaggaggctcctggcccatcggcagcgctgccgctctccatttcaaaatttgaaaatatcagcgcggcaggcggcaccgacgaaccacccgtccaaatcgacaaacgcgcggccgtctcacctcactcacctataaacgggtcccaccgtacgtctggcccacagggaggtccggtggtgctgtcctcccgcaccgaacgtgaggtgaacagaccacctactggtatttttagacctacacaccttgggagtacacatttgtgacacgcataaaactagagtacaaaaaaagtgtgtggggtccatggaacagaggcagcggtgggttgtggttgtggcaaactcaggtaccaacaaaaagtagatcagtacatgccagctccaacctccaacctccaagcctacaaccagatcagccggtctggtactgtgcttctgtggcacgaaaaaaccgaccgttgcacggacgagaaacccgaaccgtcgaaacaatcgtaatccccaggggctcaaacgcaaaacaccgtccgctcccctcgctttcgcttcgccggcactccatccgtccatcgtggcccaggctgtcgttccgttctataaagggcgtcgagaggaaaccggtggaaccctacactgagaaccgcagagacaggcgtcttcgtactcgcctatctccgcgactcaaagctttccccaattcccccccttctcccatttctcaccaccgccgccgctccccccgttcaacaacacc

SEQ ID NO: 334 - DNA, 752 bp, Zea mays
tcgtataaactatttttatctaatagtctagtctacaatatcgtaccacctaaaaatttgtcctgcgtccatcactgtgcttgttgtttggaccaccaattcatcctaaaacctgtaggtttcaaaatggttgtatatttctcttgatcaagcagttttggacatagacgtgtccatcttgaagtgcggctttgccataatcaaatcgaaacagcagaaaggcctgaaagggaataacaaaaaaagatgaatggtctggtctttacctaacccagtgagacttgtatgtcttcttagggggtgtttggtttctagtgactaatatttagtctctacattttattccatttaagttacaaaattgttaaatatagaaaccaaaactctattttagtttctatatttgacaatttatacactaaaatggaataaaatgatgagactaaatatagaaaccaaagagcgatgacgacgcaatgaacaaagcccacgataaggcccaggccagcccaagcttctgcctcgcgaaaaccctaacaattccagcccctatataaccacacccacgccgcctccgcccgaaccctagaatccaccctgccgcctcaccgcctctctcaatctggtatgtgccgtccgtcgcctcagtctcttcccgccgccgcttcggagactaacttctctccctttgttgttctctcttcgcagataccgcagatccgtcgtccggtgagtggaagccgcacgaaccc

SEQ ID NO: 335 - DNA, 6944 bp, Zea mays
acagaaaatttccaagaggaataccacccctcattcgaggctcgagggatccctcgggtacggtattagaggtacccccaacactcctaaacacggctgataagcaccctcagcacaaactgcaaagactgatgggcacggttcaggtcaaggcctcgtctaccaagggacgcagtctcgcctcgccccgagcccggcctcgggcgggaacagtagtcccggacgaattcacgcctcgcccgagggcctcctcaggcagtgggcgcaccctcggctcacccgaggcccagctcgggcaggcttcgtcgagaagcaaccttggccaaatcgcctcaccaaccgatcgtatcgcaggcgcattcaatgcgaggatcgcctgacaccttatcctggcacgcgtgcctcagtcggcaaggtcgaagtgactgcagtcacttcgctctttcactgaccgatctgacaggaaaacagcgccgctcaccccgctccgactgttgtgccagccacctgggcaaggctgacaacagcaagttcagcctcgggcgcaacaggaagctccgcctcgcccgaccttaggcctcggccttgggaggaggtctccgcctcgcccgaccccaagactcggcctcagcctcggcctcgggaggaatcgcgtcctcgcccgacctcagcctcggcctcaggagaagtctccgcctcgcccgaccttgggctcggaccgaccgcgccacaggggatacatcattaccctacccctagctagctcaggctacgagggaacaagaccggcgtcccatctggctcgccccgataacaggtaatgatggttccccgcgtgcgtccatgacgttggtggttctcagccccctacggaagcaaggagacgtcagtaggatcccagcagcaccgccagctgtgcttctacagggctcaggcacttctccgacggccacgttatcgcgtacacagggctctagcacctctccgacagccacgttggcatgtacacagggctcagacacttctctgccagacacgttagcgcataggctacaccccccattgtacacctggaccctctccttgcatctataaaagggaggtccagggccttcctacgggagggtcgcgcggagggacgagcaaacgaacatgctcactctctctctctcgcgaacgcttgtaacccctactacaagcaccccctggtgcgagataacacgagccgcatttctctcttgtgttccatcttgcgccaacccatctgggcaggggcacgcagcgacaaaattcactggtcggcccggttgagggtcccccggggtccgaaacgccgacaacacagcaactacaattctctttttgacaacgatcaactttgtcctgtttcatttcccaaagtcatacctcaaggtgtctattatagtattatcccatgttttactatcagtgttagggtctgtttggttgggctgtggctgtgaaaaaagttgttgtgggctgtgagctgtggaaaaagctgctgtagactgtaagctgttaaaaagctaaaatctgtttggtgaaaatcactaaaagtcgttaaaaattcttcgatatatgttttcacagttccatccaaaaagccactaaaagcaggtccaggggtgctttcagatttgcactacgagaaagtcggcttttagaaaaagctgcttcctggatccagccttttggttggcttttagcttttaggggggcaaaagccaaagccaaaagtcaaaccaaacacacccttagtaccccttcactatgatgtgttttcccacatctataaaatacgatctttggattgaaatatttaaatttagtactcgagtttatgtataacacttgggacactgttgaaaagaaaaagtacattaataacaagatataatatcttagggggtgtttggtttgtagggactaatgtttagtcccatcattttattccattttagtttataaattgccaattatagaaactaaaatatagttttaatttctatatttagtaattttagaactaaaatggaataaaatatagggactaaaaattagtccctagaaaccaaacacccccttagttacttaaattacaaattgtgcttctcacgcgtcttgcgcgcataatacactagttttctatctatctatctatcttctatatattaaagccggaagcaaagactcgttcccagcgtgtctacttcacgttttacattttcagccattggatcaaatttcaacggcagcaggataacgttcactctcgcctccttcaatagtcgcgagacttctagccgcatgatcacaaaccaacagcaaaaaaaaaaacgcttcacgtttctgagctgcagctaccatcggctgatgagagactcttcgagaaaccacgcgatgcgtcctctgtcctggaaaaaaatttgctacggagagaaatttggatttatgtcattataaaaattgggttttgccaaaacgccatcatgtgaacgtgtttcactaatacaccagacaaaatgctatttaggagttattatatgaaacataaaataaatttagctgaacgttagcttctagactgactgttttgcccctagatgaaataaagagtctgtgtatcggccggctctcctctgtcagttggctgccgcggctcagatcatcttgccgctgcgcctcaggttctggtgattgcccaccgatgcccgcccgcccagctatgcccggctacacaactcaatttcagtcacctaaacaaatgggcaccacgaactgctagagggcaccatgaagaaaataactgctacaaagtaatgagtgaacaaggttacaaattgaattggtctcaactggtaggtgtatataaaattggaaccgaattgatctgacagctgcttgaattttccatcttacttgctgagccgaagtagttgaagttggtggataagtcaataccagtgtacggcgtccagaatactacagtgacaaggctagcctaacccaaagtgaaaaaaaacagtagcatccatgctaacacatgatgaataagatagctgttactgttgctagctggtggagggtgccactggtggagtagtggggagtcgcacgccgttggtggaggtcgagtggagctgggcgtcgccgccgccgtctagaccatctggatgctgaatgaaatttggttccaagaccttgacgcaatggagggggctcaactggtgcttaaatcagttattagtgctatttttatagctcagtagattatggtaaaaaatagcagttatcagtgcttaaagaaaccaaatttgtgatctccaaatcagttcgaagttagcacttatctccaaatcagttagctgttatcagtgctataactttgtgatttggaggtcacaaagaaggtgctcctccaaatcttcttctattactaagctagctaacgtcgccgtacagatatttatagttgtggccgcttaataatcggaggtgccctactttaactgatcacaaatcagtataatattagcatagagacttcccacaaagaagtagcacaaaataaatgagatgaacagacctttatgttgtgctccaattgatattgcgtcatagtgcttaaagcgcaatgttatcttttatagttcagtagattatgaaaaaaaaaaactgatttggagatcacaaagaaggtgctcctccaaatcttcttccattactaagctagctatcctcaacgtatagatatttatagttgtggctgcttaataatcgaaggtgccctaatccaactgatctggagctcaacttcccctacgtgtgatgtgagtaagcggtgagtacactaccgaatgctacatggtctacctttagccactcactgcacgtatcctcaaacttgacaaacacttacataagttgaacaaagttaatcagtattagggtcttgagaaccatataagttaaacaaccacatgcagaaatacacgtaggccccgtttggatcattggaattgaattccattttaataatagtaatttaggcatatatcaattaagctaattcgtttttatgcaaaatatatttatatattattattagcaagatgtcggatatatttatgtgctatatttttactatagaggagtggaacgaagagtgtcatgtaagttacatagtagaaataaattctagtaatgcataaaatcatttcctatcctccaccctatgaatttgagatagtcttatatcttaactttggaaagtggtggaatgccaaattccaaactaaataagttactttattgagtgaattctaattccattaaaatgaagggatccaaacaccccggtaaggaaaatgatgtccattttgacatatgttggctatgctcagaatggaaggccttgtgactgaaagtcacctgttgttttcccatctaaggcatcaccctaacaagtttctaattgttttagtatgtaagctgcagccaataatccacagatgcttaaaacaactttttttccatgtcagaatgttagaataaataaatctataactaattaaaaaagactatacatctatttttaaataactcaaacatgtgagcgcaagttaataatacaatttattacaataagtgcatctattaccatccaaaacacttaaaaataacttaaatacataataaagcgcgcagaagggcgcgccccagctactagtacgtatacataccatgtaaactagtaggtctgttcagcccgtgccaaaaagtaaaaagtatatggttccatgttgtcagctcggtctgggtgcaccggactatccggtggtgcaccggacagtgtccggtgcaccaggctggctcttgcgaactcgctgctctcgggatttcatcggcggcgtacgtctataattcaccagactgtccggtgtgcaccggactgtccggtgagccaacggtcggccgggccaacggtcggctgcgcgatctgcgcgagacacgtggtcgagccaacggtcgggagggggcaccggactgtccggtgtgcaccggacagtgtccggtgcgccaacggctcccaggtgccaacggtcagcttcgctagagaaggaaagaaatcggctaccgaggcaccgagttgagacctctgctgagtacacacagtatgtggaacggaaaatgagaatgaagcgcgcacatttaaaatatgttgatgctggtgtcaaataactatttggcactagggcgcccaatagccacaattgtacatctatactactctattaagagtgtagcgtcagcgtctacacctgtccccgctcacgcgcctctggctgcccctgcccgcgccccatcattcacgcccccatccgccccaacatcctcagcgcccgtgcctcgacattcactccacacgccaccattctcgcgcccacaccccgccattcatgcctccacgcgtcgccccgccaatccccttccatcccacctcttccctgcttgactcctctcagctcatctcctcttccccaccagacggtctaactccctctcccaaaccctagggctcgagcctgcctcctcaatgagatgcccatgggccatggcagcggcctctgcccgtcgcagaggaggggacgcatgtggcgcacccccggttctcgtggcgacgacgataaatcaggggcgttgcggtgacatcggtgggtgtcgcctccacaatgaggcatccatgggacatggcgttggtgcccctggccgccccatcctcagcatgcaaaagtctcggatgtgtcgctcctccatgctctcgtcgccctggattcctctgcgagatcgagctccacctccttatgaatcatctaggcctcttagtggtgttttggtaattaatgacaacctcttgtggactaataattcttggagaaataagaatgcaggttggaccatagaaaacagaaaaagtcttggagacttataagcattggttgtggatcaagtgaagacaaagatataacatgtgttttgtttttgccggacatcagaatttcagagaaaaattgaccgaattagtaggctagatagtcgtactattaagaggggtcaattgctttggtcggtgtaaaacttagtgcctcatagagcatctagagttaaaatcttttctaaagcgtgtttagaaaacggctaagttttggggtcggcggaccatccggactgtacgcgatctatccagagggatccgtagtttcacatgtctttgtggccttgtgcggaccgtctggccagggtcagcggaccgtctgcaagtgccaaaatggatttgggcaggcactccgtgttttggggcttttgtactatggaacgtcggaggctttagcccggacagtactaaatcctagggcctgttggacgaacagttcgcccatgagctttgacacgattcaagttgtcaggtcccggatcgtccgatctcggcgtgggtggtgcagctgcgcccaatgccgatgatcttcgtggtcgccgcgaggagactctgcgccaccgcaaccgccatggtcggcgggggttgctggagtggaactggaactgggcacaggcgggacattccagactttagcgtgggaacttgacaggccaactgtaatcttggctctctctcagcatggcgcatgggctgaccctgaaagaaaggagtctccaattttactgggctctcttcggtttttgggtccactgcttccaaggcccagcatctgacagtcgcatgccatgacgcacaaaacccacggcggcacggccccattccgcgtccacactctctatataaagtgttccctcactccactccaagccctagccgcatcccttctttcattcgccgccgccgcctgctctctgctgccgtcgcc

SEQ ID NO: 336 - DNA, 1947 bp, Zea mays
accgctgccttcatgcagtcacttgtgataatagcaattttgaatctgtggtttagccaatcgatttgttccattgtctagcagtcccattgggttgttccttatttcactgaactcacttatcaaatggatgaggctagccctatcatattgtagctaacgtagccatattcatatttcacactaaatgggtatggctggttttcaaatttcttctttttttaaccatgtcactgttactggtaattctggtacataaaaagaaccattactagtaatttgttcctttttagtgcatgttgctgataagctgagatttccatatacacttgaattggctaatggacataacacctttcagttttttgctcaaaaggttttttgtgtgtcaaggttaccaacttaccatgaacagtatctgaaatcttccaccattagctctattcacattctccatgtttgtattgaaacatcattgggtaacagctatatgctgttatagaatagtatctttttttaacttcataatttatatatggagaaggcagccttctgataataagacttgctcccttgccactattgtcgttaagatcctctgttccagaacatgaatagcaactgcctggctggaagttgtgtcatatgcatgatgcatcttcccttaaagcctttcctggttgttaaggttgtcgtgaagcaccacactgattactgatgtcctcattcaccttcacttacaagttaaaaccaggccttgaagtctgtgttgttgataatacgatctcattttacttgtaagatgccctctagataatctatcattctgatggcaaatgatgacagtcatcagtaaccatatcaaatatataggagtttctaaactgcagttataattgatttggtctcatactgctgctgccttcaaaagtcccatcgtttgtttagttttccgacctctccaccgttaccttcaattgaaacaagacattcatgtcctatgactgatcccttgacatttactctgatcccttgacatttactctgatcccttgacataacactagttaattaccaacggcggaaattgtggggatcagcatggttaatttttggttcattgttgcaattgcgggcacttaacatgcattacctatttcaaacttcattctacaaaaacaatggcatctaaagtgttgcatctcctattttatgtgattcatcaaagacggcccaacaatttgtagcgaagggatatgttttttagtagtttaattgtatggcgatcgaacgagatgcttttttaccgacttattgatgtcaaagaagtgtcgacttagtttcgtcttcgagcctaagcgagctcgagccgactggcgagcctcgcgttttcttcctttccccatttcgattttttgttccaaaccagcgccgtcagaactgaaataaacacgtgctgatacgaggcatatcagctgagaaataataatgtttgatcgacatttttttttgcaagttctggttcaaaaaaaaacatttccaaaccatatcagataataacaagtacttctacaagcctgtaagcagaaccaagacaatttctaatgttttattttatacaacacaaacacagaaagcaaaagaaagattttcgggaaaaaaaacacagaagaaagaaattccatcacagaaggcttcagatgacgcatactgggccgtaacgtcccgagcgcaagggcgtagcccaaccaacggcccatatctaaacggcgcagccccagcggaaaccctcagcgtcgccgttcagtataaagtagcgcccccaaaccctaccggcacctctctgctaacgccgctcgcgcatcctattgccctcgcgccaccgtcgccgccgctgcagcgagccaccgccctgccgtcgcctgaggtagacaccaagccaccgcc

SEQ ID NO: 337 - DNA, 1058 bp, Zea mays
ctaaatttaagaccgataggattggatttttgacttgttgatcttttagaaaaaaggggttctgttggaggtgttttttaagagattgccctatatttcaaaatatcaatatatttagaacttctattggagttactctaatcgtatcagctgcacttgcgtacaggctaccggcgtcctcagccacgtaagaaaaggcccaataaaggcccaactacaaccagcggatatatatactggagcctggcgagatcaccctaacccctcacactcccatccagccgccaccaggtgcagagtctttcgtcatctcttctccggcgaagaacccccagtcgcccaccaggtattggcaccctctttctcttccatgtctactgtgtgaaatcgagttccgaatctctaacctcgagctatttggctatttgatgcgtactaatttctactccgttttctagatccggccctgggtactagtgtttcgagatagcatctaatctgaattttttcgttagctgttagttatccgttctattgtgcagcaataccgatatgcagatttagctcgtagctctttatgttcctccgttgctgtcataacggttataattgcgattatatggcgagctttacaatcttagttattatgatactctgtctggtcgaatctactattaagtagaacatatggttttacaattctatgatctgtgatcctattattgtcctattagggctctgatcccaactcagtatcatgatttcaagaaatttggttgatgggatatgttttttctgtgcccataagttgttactcaagctttgaattaagctatgacatttcagaaacatagatttggtttggattttggttcagggtgcttgttagatgtaatatctgcatagttgtttaaggattatgctcacagtaacagtagcagcattttttctctgttcattgaacgtctgtgtaactgttgtcacgagttgacatttcaagttctaacactgctctcatatgtgccatcagatcacttgttaaactttgttgaggggtg

SEQ ID NO: 338 - DNA, 10000 bp, Zea mays
ccaaccagagtcaaattctgatgactggagggaaccaatcatcagatatataaagaatgaggaggagccggatgacaaaaatgcagcagagcgcattgcgaggcagtcagctcactatactctcattggggaaacactatacagaaggggcacgacaggagtcttcatgaaatgcattctttcggctactgggaagcaactgctagatgaggtccatgctgggcaatgcgggatacacgcagcatccaggactctagttgggaaggtcttcaggtctggtttctactagccaatggcaaaaagttacgcagccgagttagtccagagatgtgaagcttgtcaatacttatcaaaacaacagcatctaccagcacagcaactgcaaaccatacttgtgacatggccattcacgtgctggggactggatatgattggacccttcaagaaagctcaaggatgatacactcatgtactggttgctattgacaaattcactaagtggatagagtacaagcccattgcttctctaacttcagctaaagcagtggaattcatacaagacataatattcaggttcggaataccgaatagcatcataactgacctgggatccaatttcactagttcagagttctttgatttctgtgaacaaaaaagcatccagatcaaatatgcatcagtgacacacccaagagccaacgggcaggtagaaagagccaacgaaatgatattggaagcactcagaaagaaagtcttcgacaagaatgaaaagtttgcaggaaagtggatcagagagttggcatatgtggtctggagcctgagaactcaacctagccgagctttgcatggaaacactcccttctttatggtctatgattcagaggtagtactacctgctgatctcaagtttggggcaccaagattgatcttcgaaaacatagctgaagctgaggccactagactagaggatgttgatatactggaagaagaacgattgaatatagtgattcagtcagccaagtaccagcaaactctgaggcgctatcatgataaggccatatggcatcgatccttcacagtgggagatcttgtcctccgctgaattctaacgggggagggacgacacaaattatcgccactatgggaaggaccattcatagtagcagaagtcactcggcctggatcatatcgtcttactcaaatggatggcacagaaatagggaactcatggaatatagagcatcttaggaagttttacccctagctagaattcaaaagctattgggatggtactgtattctgtaattggataatgcaccatcaataaaaagtcttcattctcaaaggcactcgaactgtttattgtcaatctacatgcttactcgactcagggtgaccactataccctactaatggagcaatcgacttaagttggcgacaacttaaggcggtgtgacacgctcacgcttactcaactcagggtgaccactatgccctactaacggagcaatcgacttaagtcgatgacgacttaaggcggtgtgacatgctcacgcttacttaactcagggtgaccactatgccctactaacggagcaatcggcttaagtcggcgatgacttaagacggtgtgacatgctcatgcttacttaattcagggtgaccactataccctactaacagagcaatcgacttaagtcggcgatgacttaaggcagtgtgacatgctcacgcttacttaacccagggtgaccactagacccaactaacggggcagtcggtttaagtcagaagtgacttaaatcggcgcgacatgctcacgtctactcgatctagcataagcacgcttgcgattactcgtcttagggcgatctctacgcctcgcgaaatagaaagaagtttcaaaaccatcacattgcacttacttctgcaaacgtaacaactgttgaattcaaacaacagaaaaataataataacatttagtaccaagaatactttctaacagaatattcgagcacattgaccacatacacaatgcattcagtgtttctacttggtaatgtttttctcaggagcaactgatgaggaagagctactcgaagaatcaggagcaacgttgacatcaacaattatgtcgtcaggaacaatcacacccgaccttctcatcaagatccgccccgcgcgaatggctttgtccatagccttgtcacgctgagccttcaaagtagtggaagtgtcttcagcagccttgacagccagccgagcagcttctagctcctggacgactaatcttttggaagcgcgtagatccttgatgacaaaatctttgcttgacaccaattgcctaagacgaaggatttcatcctgggactcttgcagcttgtgacggtgattatccaagtttgtcatggtaaagcgatggctcctctctaagatagtcaaaaaattgttggcgtcacgatacaacctatcaaggttatcgcgagaagctgcaagggcacattttcttcctacagacaagaatcagctctcaaacacccagcgggcagcaagaacacagcagagaaagtcaaaataaacttacttcattagtcacccttttagagtcaagctgagcactgagagaggaattcaataagttggcatcatctaaagaagcagaaacttgagccaggtttatctgaccctgagagtacttctccttgagctcagagtaccaccggaccatatctagaaagaaatggttgaagaaatatattcagtaaaaagcagattaatcaaatagccaaagaggaaacagaggcactaaccagcatttgtcacctccaaatcagatacctgccgctgaagcagcattggattccaatgcgtcagagacagagctctttctgggacagaggcaccctgtgatctcagctgaccagccatctcgtcaaccaaagcctgatattgaaaacgaatgagtgcaaagacagtatttcgcccggagtatagccagatcgggaaaaaaagccaaattacctgaagattggagaagaatgaaggaagccccaaatcatgagaagccagttggtgactcgacgaaggaatatcaatcgaagcaatctgaaaagcatcattggggatcaactcaacatcaccagcaggaatcaaaactctagcgtcaggtgcgtcggtctctaaggtgacttcctgatttgaagcacgtgttgctgccatataatcagaatgtggaggagaagacccgacgtggacatccatggaggtatgagaaggggagcccgctcggacaccctcgggggctgggtcgtagcccacattgcccatcggagccggatcaccaccgacagcaccctcgggggctgggttgtagctcgcgctgcccagtcgagccggatcattatcggcaacaccctcgggggctgggtaaccgctagcaccatccttggggaccgggttctctgcagcagccacctctaaggctaaaggattctcagtcacctccatgggaatggagcaacctagaccagcttcttgattctgaaaaccacactccaaggtcgacgaggcacgagacgctgctcgggataactctaaccccacatccggaatgttagtgcaaacgtccatcatgccaccatctgttggctcgtatagcagatcttcaggaaccatatcctcgagagcctgatcaaaatttgctatggacaactcttgcagaccaacaagagcagacaaagctggagaaggaacatcactactctccccactgactaggtagcgccgactgtttttccgaattaaggggatttcctcatcttcttcctcatcctcgtcaacaatacgaacaacacacccattggggtcagctctggccggattgcacccattggggtcagctctagctggattgcacccattggggtcagctctggctggattgcatctagtgggttcagcatcatcgaggtcacacccattggggttagcgtcagcagggtcacacccattgggatcagctccagtaaaaagttccactggtacttcttcagcagcaggaacagaagggccgacatcctgattcaaacatgacactcgccgaagcctcctctttttcttcttcttcccctcgacaggagcagttgagtgactggccgggcgaaggcgctttgggtgagcaccatcagatttttgagcattcaaggttttttcgggctctgggataatcgcaatagctatggtttcagtagggacagagtcagaagaatcctcagccaacatgtccagcatagcacttatctctgcatcgcttgggtttataggcatctcaaagtgaacttgtctctcatcattggggagatcaccaagtgaagcaaccagagcctcaacttcttcgggagagggtcgcactctaagacccaagccattgtcactagcaggaggattggacacaaaattgaaaaaagtcttggaaggtggcagattccaggcagaatatgcaacaggagcaccaatattcgacactttgcctctgaggatcatctccagccggcttaccaaatccacaacaggaatcctcttgttggtaactcgggttgagtcagtgacaccactatacaaataagccgggtacgctctgtccttcagtgactgaatgttcttaaaaacaaagtctgcaactacagcttcagcagtcagacctctctccttcaacaaaccaatttcggcaagcagaaccctggcctatgttatctccaagtctgtgggggattcagtccaacttggagcacaaacatctgactgtctccctgaccgagggggagggacttgccatgattctctacaataaaccactccaagcgccatcctttgatgctgtccttgagtgggatgtcgaggtactatcttcctcccacgatgcatctccaaactcacaccacccacgagctggtgctgcccccggccattctaggccgacaatgatataagtacttccacaagccaaaatgcggcagaattctgaggtaggcttcacacaagtgaacaaaaacagaaacttgcagaatagagttgagattcagatgagtcagattcagatggtagaaatcaaggagaccatgaaagaaaggagaaataggaagagcaaggccgcagatgagaaaaggaatgtaaataacagactcgtgggtatcctccgttgggacagtaaccccacgacagatctgccaagagcaaagctcctttggaggaagaactccgacggagacaagatggagaaggtccgactcagaaacaacagacatatgattacctgtgaaaggtaattggctgttgggatcgatgggaggaataatcgcagcggtggaattctgactcttcgcttgggcgccatctcaatctcgtcggcgaactgggcagaagcgagatcacagggaaacagagaaggtctagaagcagaaagtaaggctagggctcagaatacagaggcatgcgacgacgcggtacaaatggggttttcccgggtcagacaccgattctaaaagtgccagtcatcacttgattgttacttctaaaatgccgacgtggctcaatgtaactcaaccgttatttctaaaacactgacgtcatcggtcttcactcagttgttacttctaaaacgccgatgtggctcaatgtaactcagccgttatttctaaaacgctgacgtcaccggccttcactcggctgttacttctaaaacgccgacgtggctcaatgtaacttagtcgttatttctaaaacgcggacgtcaccggtctttactcgactgttacctctaaaacaccagcgtcgcaaaaaccattcagctattacctctgaagatactgacagtaaatcagccattttttctctaagaatatgtaggcggacttaaaaatgcgactaaacaattccaagttgttacttgagcattacctctgagaagaacggctacattaagcacaagtacaatcgatcgaccgactgcaaaaggaacgacagaaaaacaagaaatgcacacagaacaagctgaagtcttcttcattatataaggaggggaagtattttcacaaacttaaaaaccaactcattatgagttggtcttcttcccactattcgatacattacactactacattacatttcactacactatactactaactactactatattattctactaatactacttctactgctatttatgtatactaacatctaagccagtggcacttagccactggccttgccgctgccgctgccgcccttgctatcgcccttgccgccgcccttactgccgtcaccatcaccgtcgcccccgtcgtcgccgtcgccctcgccgtcgtcgtcaccgtcgttcccctcctcggacgagtcagaggagttcccctcgtccgaggagacctccgactcatccgagccctcgagcccagcaagctcgacggcccggatgtatgtccacacttctgcagcaatcccctgggaatcgtctgagtcgtcagacgatgccgggggaggggcatggaccggcgatccctcgaactcagaggagaactcctcctccgagtactcggaatcgccgaagtcctccgagggaggagtcggctcacgcttccgcttgtcgccggagtggtgcgaggagctttcgcctttcttgctcttgcccatggtggagtagaagagaagagagtaagcagcaagcggcagagagatgtgtgaagacaccagtgaaacaagcgctctatttatagaagaagaaggcaaccgctcatctcctaccacggtcactgaacaatcacaaatattcaataagcaatccaaatcgtctgcaaacaagtcagacggctgtcgccgtttcacgtaacacgacacccattgagactcaagtcaactgcttggacggtatgattacacccgcggtcacgtcaagttaactactcaggggcagtttgctaaacgctcagcgcaccaagtcgtcccttgctcacacccattggggggacgtccaggaattttcaatatattttcccaagcagtcacatccacacagtatacataatgaatgtatcaagacagaagaaatatatcgatggagatcgaaggaaagccaaaaatagatgatgaagtacaagtctaatcaacagaagcattgaagcgcgaagtgatatgaagactagccaagagccatctaccagatgtccaatctgtcgcagatcaaataaatttcaaacctaacaggacatgggcagatcgcacgctcgatctcaaaggcaagactgtacgctaacctctaaagcataaagttgatgatataatgctgatctctaaggcattcgacgaagaggaaaggatgatttctaaaaacagcatgagatgaagacctttgaatggattattttcagtaatccactcaaagctcgggggctacacccattgggtgcacctccgatgcacccaatagatcatcaaccccaaaagacaaaatgctgatttctaaagcatgaaataaaaataaaacaatgctaacttctaaagcatgagttctaaaaagacttgagatgaagaccttcgagtgggttattttcagtaatccactcgaagctcggggctacacccaatgaatcctaaattccagaaagcagaatgctgatctctaaagcataaacctgagacagagcaccgatttctgaggaataaagcgaagaccgatgaataatggcagaagaaaacaacagaagatcgtttttaccaagtcactcagagttcagaaacaatggcttggcggacctattttcaatgcattccttatcaaaatcaaaaaccgcaagctgaacctaggatctttgggccggttatttctaaatcaacccaaagatcgggggcttgtgggggacagatatcccccgggtccactggaaggctaaaagaccccacgaaaggccttgggcccaatagttcgtaaggtcattccttcgtgggcctggggagggacgtccagtgaagtggattgacacaagattggatcaacgcaagcctagacggcctaatgaatttgagcagcaatcgcgacaatgatccgaccttctcgtacaatgtcctcatacatcgaaactgaacggagataggtcggcagaattataggaagataggctcagtcggttcactattacttaggctcacgctgttatcatatccgcatgtaacgccccacggtcgagtatataaggcctagggggcatccccctcaaaaagatatatctcacaacttagccagccactcagttctctaacatcctcgatactagagaactccctttgtaacccatcacacaaagtatccacgccaggacgtagggtattacgcacctcgaagcggcccgaacctgtacaaaattgtccacggtctctcgtgcatctggcacgaaccatcgagctacagtcggtaacaccgtcctaccccaaaaagcacctcgagggacaaccctgggtgcgcgatcggacccaaaacaccgacaacacgtctatagatggccaaacagcggcccggcacgggccagacacccgcgggccataacactggtccaggcacgtcatgttggcctgctggctgtgccgggccagccctttagcccgtcggaccatttgattaaatcaacgtaaaatttaaaaaagggtggaggatgtggggtttgaactcattgctctgatgtaagaagggcgggagacactgggtaaagctgtctaaccagtagaacatcatgtttatatgtttttaatatgtatatatatgtatatatgttttttataaaataaaaaatatataatcgtcttaggccggatcagcactacggaccgaggctacagcccaagcacgtcacgacgttcttggctcttgcaagcatgaagtcgtttctgagaccacattggcgcaatggactctatggtgtttgaggttgctaaattggatggggcaacaattatttgccacaataacaggaaatgaaatgttatttgttgattttaagcgttagtaattgctacgaagtagcataatttatatagagcgcatccatattttattgatgcctgaatttagcaatcactctatattttgatttatcctttttataagtttgagttcatgtgacttattttagaaacttgagctcacaaacttttcttatttggtctatgtatggtagaattatgtcattttataatctctattcgttcagtagtcgctgtgaactcttttctagtcgctcacttcattgaccgtgttgtaccaagatatattgaatggagtaaataataacatcagttagccaaatcaaaaaatatattatacggagagcggagacaatcaataaaaaatattgaaatatttttactggatagtttatataggtattgttataagccgtttgcaacgcacgggcaatcgactagtattatttaacgtgtgtgctttgtttctttaatgtcattttgtcatttttttttctcatgcgatgaacacgaagatgacaattcgcaaaacaaaatgattacgattcttaaacctttagtcggccggggcatggcatggcatgtcaaaagcaaaacaaaatggcttatggaaaactggaagtgcctagtcagtccaacccaaagagcgatgacgacgcagggaacaaagcccacgacaaggcccaatacggcccaaacttctgccactggcaaagccctaccaacccaagcacctatattatgtccacccacgccgcctccctccgaaaccctagaagcctccaccctccagcgcctccaccttcctcgccgcctcactccctctggtacgtgccgtcggctccacctctggctcgcgcccttgcttgccgccgctgccgccgcgattggcgcctaacctcggtgtcgtgtttttcttttcttagcagaggtcgcagatccgtccggttagacgaagccgcccgcaccc

SEQ ID NO: 339 - DNA, 10000 bp, Zea mays
ccccgcggggatcggggacggggaataggataccatacccgtccccgccagacccgatggggatagtttttctcccatttaattccccgtggggagcaaattgcaaccatccccatcccctaatgagtgaattccccgcggggaatcggggaacggggccccgttgccatctctatctccaacgatgcatatccgtcgtcgaaggacaggagctattgcaagagatacactcgggggcttgcggtcaccatgcagcacctcgagccctcgttgggaacgccttccgacaaggcttctactggtcgaccacggtggccgacgccactaggattatgcgctcttgccaagggtgtcaattctatgcaagacagacgcacctgcccgctcaagccctgcagacaatacccatcacctagctgtttgttgtgtggggtctggacctcattggtcccttgcagaaggcacccgggggcttctcgcacctgctagtcgccatcgacaaattctccaagtggatcgaggtccgacccctaacaagcatcaggtccgagcaggcagtggcgttcttcaccaacatcatccatcgttttggggtcccaaactccatcatcaccgacaatggcacccagttcactgggaagaagttcctggacttctgcgaggaccaccacatccgtgtggactgggccgccgtagctcaccccatgacgaatgggcaggtggagcgtgccaacagtatgcttctgcagggacttaaaccgaggatctacaacgacctcaacaagttcggcaagcggtggatgaaggaactaccctcggtggtctggagtctgaggacgatgccaagccgagccacgggtttctcaccgttctttctagtctatggggccaaggctatcctgcccacagacttagaatatggttccctgaggacaaaggcgtacgacgaccgaagcaaccagaccagccgagaagactcactggaccagctggaagaggctcgggacgtggccttgctacactcgacgcggtatcagcagtccctgtgacactaccacgcccgaggggttcggccccgaggtttctaggtgggagacttggtacttcggctgcgccaagacgctcgagggcgccacaagcttactcctccctgggaagggtcgttcaccatcgccaagattttgaagcccggaacatacaagctggccaacgatcaaggcgaggtctacggtaacgcttggaacatccaacaactacatcgcttttacccttaagatgtttcaagtcgttcatacacctcgttctcttttcatacataaataaagtctaaccgtcaaggaagggtcagccttgcctcggcaaagcccgaccctccctcgggggctagaaggggggaaccccctctgcgtcaaaattttcctcggaaaaagtctttctgccagaacgtctttcgcgcttttcgactgctttgatagcgggatcctgaaaacgacgagagtacacgtaagcggcaaggccgaccgagccgagggactcctacgcctccgggatacggatacctcactcatcaccttccgcgataagtaactcatgctcggataagtgattctgctaccaaacaagtcctaacgctcgaaaacttttcttctagaacgattttcgtgccttctcgactatatcgataacagaatcctgcagacgagcaagagtacacgtaagcggcaaggccgaccgagccgagggactcctacgcctctgggatacggatacctcactcatcaccttccgcaaaaagtaactctcgctctgataagcgattctgctaccgacgaacaagtcctgatactcgaaacaagaggaaaggaaacacagctttataacacgacaataagatgtttgggcctcggcggtcgcaacaagcatacgcatactacagacaaactgttcctgtaggttcagacatcgacagagggagcagcagcaccctcggcgtcgtttccaccttcggcggaatctggcccggcctcagacggcgacacgggcggaaggatctccacctcgaaggaggaagccagcaccacgcttgggccatcgcagccagagtctctacaagggttccggcccgagcggacgcctcggctggccgctccgtagcctcagccagctatcccccgagggcctcagcccggctcacggcctcggcagcgtgactccggggttggtcccgttcgcggatgacctagccaagctccaaccgccgccgctgcacctcctcggcctaggaagccacctgctcctaggccgacaaagactcttttcgagtcgactccgcctctgtccatgctgacaccgctgcctccggctccagctcattgcagagcagccgagggttcttaaactgagcaagagaagccttgagtggtaaggtcgaccgagccgagggactcctacgcctcggggatacggatacctcactcgtcaccttccgcacagggcaactcacactcggttaagcggttcagctagccgacaggcgagtcctagtgctcaaaatgaggaagaaacacggtattacgctcaaatacccagatgttcaggctttgacagccacaatgaacaaacaccggcactcaaggtgccattacaaacagaactccggttccactcccgcgggtatgaactacctccacaccagagggcctgcaggacgacaagctccgggtggctcgccggcgaccgctgcaccaacagcgaggcaacgacctccgtctcggacgacaagacaacagcagcgatggccccagggcgaacgttaccgttggaaggccctcgttcacgtcccctcgcgggggacgagaaccagccattaaagccaaagagccggaggcccggagcgcaggtggcactgacggtgctgtcggtggagaaaccttctccggctgccaccacctcagcaccgacgacagcggccacctgcccaccaacaccgcaccagcgagcggcggccgccccaaagcgcaccggtaggtcctcactcccgttctcgccacgagaacgagaatgggaccgtcccaaaacacgagtactgccccttgtggcgtacgacgtgttgtgtgaccccccagtgcagccggccatagtcgctcgggcggaggacggaatgttgcaccctggccaggcagcagcagttcgccttcccccgcatggctggaggacgcctcctccgcagagctggaggatgtcttcctcccccggatgccggaggaagaagcgggtcgccgacccgcgcggagacaggccccggctcgccccgccctccttcccgccacggatgatgaagatccttgaagtgagggcggggcagaggtcgcagcccggcttgcttctccccaccatctaactggtggtcaccatcctaggtgaccattagtgagggaatgcggccgggctgcctgatgaaaatccttgaagccgagcgatggctgaagggtgccaacccccgcgaggtcgtgctccttcaacagcagcaagacgaaggcaacgcgggtgctccccatccgggggctcggaaggtggaagggcgcgatacatgaggggagtgcgaaggcatggctaccgctcgggggatcgacccctttttaaaggcggctctccacactcacgtcctcaggcgttacggacaaagtcttcaccaacgtgctccagggtcctccctctacgacacgggggctaggtcccacacgtcatgcaagctgacccaaaacggaggaagccaaaccgccgcgcgcggagcatgtaaccgccccgtggttacaagcactcctccgtcctcgccgaaaccagcggtcgaaagggcggactgccatgcaggtggcatgcaaccgcaccgtgggggtgcaccccttcggcttcgtcgcatccagcatggaggcccaggcccacacatcatgtaaccggcgcgtcggttactacgtgcaagaaactgcaccgccacttgcgccaatgtcgcgccttctcgactgcggaaccagtgccgcgactcgaggcaaccctgcgcatggccctacagtgccaatcgagcacatcgatcacaggtcagtcagtcgtgggaggaggcgcaacggtcgatatggccaaaagtggaccggtagtaatggcggcagcagacgggcagaagtagcggtcaaatcgcctgcagactcgtgtcccctcctgaagcagcaagggaaccctccccacggcgtgaagacaacacgcccgtgttccgtccttcgaacggcacgcgcacgcggccaccccgcgaaccacccgtcccgtcgcattaactcctcggcagggcaagcgacacctttggcaggcgaagcgaacgtcgtttcacctctgccatgatgaccgcgtcaaaaaaaggtgtgccccaccatttaaattcatatccttttcctcttcccctttctctctcttgctacagggaccgggaaaggggatatttcgaaagggatccttctccgcgaaggaagcgggccccgagcccccctactgatcaggggttcgaaggttggcccctcggaagggtttcgacaactgccccagagcactcggacttcaagctcattactgatcaggggttcgaaggctggcccctcgaaagggttcgacagccgccccagagcactcgggctccgcgtccactactgatcaggggttcgaaggctggcccctcggaagggttcgacagccacctcagagcacgcagagcgagggatgactctagatacgtccattacatggccgaggctcgggctacactcccgaggtaccctaggacatttctgagaccagcaggagcgattttgtaacggaatcccatcagagggaggcatcgagccctcggaccctatcgaacgggaccgggtccggcaaatcacatgcaggtacttttggagcgcgcctctaggccactagccgacccttatcgaatggggcacatgcgttcactcggatcacccgttagcaactcactggagacaccatgttcgacgccctccgagggcaacatggcgcttccccccttcctccttgtggaaaggcgacgaaggggcatataataaaagtcgagacagtccttgatcgtcctctcgctccgtgcagaggctcgggggctgctctcgcaaaacccggctacgcccaaaccgttgacagcgtcaacaaaccagcctaaaaacttggaactcgaccatgcacccgggctacgatcaggtcgcatgagggaacaaccaggtcggccaaggcatcacgaaaggcattaagacctcagaggagtcaaaccactccttcgaggcctcgggggctacacccggcgggtgcgctcgcgcgcacccaccgaaataaagtgcaaccgagaaaggccggtccccttgcaaaaaagtgcgacaaagcctccaagcgagtaccaacactcccttagaggctcgggggctactgtcgggtaccgtaattaggggtacccccaacactcctaaacacgaccggtaacccccatcagcacaagttacagagactgatgggcacgattcaggtcaaggctccgtctactcaagggacgtgatctcgcctcgcccgagcccagcctcgggcgggaacagtagtcccagatgaattcacacctcgcccgagggcctcctcaagcaacaggcgcaccctcgactcgcccgaaccccagctcgggcgggcttcgttgtgaagcaaccttggccaaatcacctcaccaaccgatcgtatcgcaggcgcattcaatgcgagggtcgcctgataccttatcctgacacacgagcctcagtcggcaaggtcgaagtgaccgcagtcactttgccctttcactgaccgacctgacaggaaaacagcgccactcgccccgctccgactgctgtgccacccgctagggcgaagctgacaacagtcaagtttagcctcaggcgcaacaggaatctccgcctcgcccgacccctggggctcggcttcaacctcggcctcggagggtggtctccgcctcgcccgacattgggcctcggcctcaagaggaggtctctgccttgcccgacccaagggctcggcccctgcctcggcctcggaaggtggtctccgcctcgcccgaccctagggctcggcctcaacctcgacctcagaaggaatcacgtcctcgcccgaccccagggctcggcctcaacctcgacctcggaaggaattgtgtcctcgcccaaccctggcctcagcctcaggaggagtctccgcctcgcccgaccttgggctcggaccgaccgtgccacagaggatgcatcattaccctacccctagctagctcaggttacgggggaacaagaccggcgtcccatccaggctcgccccggtaacaagtaatgatggatccccacgtgtgtccatgacgacggtggttctcagccccttacagaagtaaggagacgtcagcaaggtcccagcagccccgacagctgtgcttctacagggctcaagcgctccttcgacggccacgataccgcgtacacagggctctagcacctctccgacagccacgttggcatgtacacagggctcaggcacctctctgccggacacgttagcacatagctacacccccattgtacacctggaccctctccttgcatctataaaagggaggtccagggcctccatgcgggagggtcgcgcgggagaatgggttgacgaacaggctcactctctctatcgcgaacgcttgtaacccctactacgagcgcatccccctggcgcaagataacacgagccgtgttttcccctttcgtgttccatctcgcgccaacccatctgggctgggacacgcagcgacaattttactcgtcggtccagggaccccccgtggtcgaaacgtcgacatattccttcaattcaacctcgtgcgaagtaagatttgccatagtagacttatcaagcgcacacactagccttttatgatggttttgtatatcccctacgatacgttgcaactgctctcgttgttcgtcgatgtaagctttaagagattgaagttcgttggtgctacttacattgggggtaatcgtagtaggtcggagcgaagccggatctgtcgcccgttgccgaacgactttgttgttcctgtccaccttgaagtcggccaggaactttgcctttgcttcttggatcagctgctcctggcgctcctcgaacaggagttgttcctcagccggcaaggtttcccatgtcggcgtgatgatattgctggtggaaacttcagagatatcctttgaaccgtccattgagggccgatttgataggtctatatgtgttttccccagcggagtcgccaagaagtatgttgacacctttttagggcgccaatcactcaacacgaaccagcggcggtgctctctgcgcaggggcggacggtccgcggcctggcgcaaggctaaggtttcctgcctgacggctggatggtccgcgccctggggccggacggtccgcgcgtgcgcaggggtggcggaagatcgccggcggcgcctggatctcgctcctaggagggaccccgtcggggaggagagatcctaggagttgtctaggctcgggcaggccgacctagactcctctaatcgacgtagagtcgaagagaagcggagaatttagggattgagaggctaaactagaactagactagaactattcctaagaataaatataaattgtattgattgaaggttcgattgatgattataaatcggccgtatacctctgtatttatagaggaggggggctggacacgttacaaacaaactccccgagctaatcccgcgaatttcgctaacaaacacggcaagaaactcggaaccctaatctgttctgcgcgcgcggaccgtccggcccatagacgcggactgtccggaccgcggaccgtccggccctaggaccgaaccgtccgctagctctttttggtgcccaacagtgattaaagttagctattcctaaggaataaggatagcaccaacaaaaaatgattagttgggctcattgaatcacgtgaaatgtccatcctactacaaatgagaagatgagtcaatcctccatactatccccactttagtttaaccgacccaccctactgcactcctaaccataggaacatgaagcgaaacataccttccgaagcatctcttctgcatttggttgatcctcacgctgcaggctgatgaaataagactggagcttcttcgcagcctccatgaaatccctcgcgtgcctttcaacatcaaccgtgcaactcagtagaaaccgcgacacttaaatatcctgtttggtaggaccgaatgtcaaagtgcaattttacttatctaataaccattgtgcacaatttaagtccgcatataaaaaatgatacaagattcgttctcctcagtctcaggacctaatcaactaatcgctatgcatttgcctgggaacaagaaagatgcaaaatatccctctagaaagaggaaggccccgtcatccatctcggattctcgtaggcaaaacaacgcacacctggcgcgcgacggcgccgtggaccgaacgagcaccacgaggcttggctagtgccgcagcagcgcagagcgaagtagagaggaagagagggaggaaatgatggggggtcggcactccgtactctggtgggaggaccggagggagcggtcgacggcctggagctcgcgcgcgggcaggcacggcagcaggtccgcgcgcccgccctccacgggagtctgctgcgccgatggcgggggcggcgtctgcgctggcgactgcgtcgacgtaggttcagccatgccggagagggtgagtgtccgacggaggtttggaagggcctccgattgcttttgacaaccgttgaatttttttctatgcagtactccttttaatagctctcagcttatttataggtggtattatccttcttactctaacgtctttttaattaggaaaattccaaattactcttaatgttcgcataaacctctaaactaatttttagaacacttaagaagaatggagcgactccatcttattttctggatgtttgattttcaacagaaaaaagagtggagcggttcctagagtttccatatgaaaatttaacataaatagttagaatattcccgctctataaaaacgaccagatgtgagcgcttttccgaatgcgagcgctctgctccctctcatcccctctatactcatatgactctctaaccaaacaaagaacgaagcgtcttcactctattctactttttaaccaaacaaaaaatggagggacttcactctacttgccaaatgcaggataaaacgattgtattctcaaaaactagaatagaatcgctccattctagttgactctccaaccaaacacacccttactcatccactcctttaagttggttcaatttactccttaacaaaatttattttttcttcacgtaaaaaacaagttatttgttcaaatttgttggttagtagctaatagcatattttagagtaactaaaaaaatatattatgattctttataatcattttgataggttagaaatctaataaaataataactttaatggtataaaactaaatataaaatattgataaaaatttctaatatatttttcaaacataaattatgatatccttgaaattcaacttgttatatttattgtgacataactaaactttagtcaaaaggaaccaaacaatataatagaccataaaagtctatctccgtagtccatcaaggcccacgtatgacagcccaatagcccactaattcaaaaccctagcagcaccacccgtcttcctcttcacccacattataaagatcctccacttcgcactttcgccgccgcctctctccttcccgagcaggaggcggacaaggtaagcagcaatcgcaggaaccctagcgccgccgcacccgcagga

SEQ ID NO: 340 - DNA, 5304 bp, Zea mays
aggaaaatcacagaccttgtttcttggtcttggcgtggaccgacacaaataaaacttcattttggtcagatctcagggcccagaaaaatgtagatccattattttcgtggcaggccggacgaaaattgggtaccgggcccacgaaaaataaggtgtatttttcgtccggttccgtaggtcgacgaaaataacttattttatttttcgtgggccgaccgacgaaaatatctaggcccacgaaaaaattaggcgttttcctatagtgtccactgcactccggtattagtgtattttaattccaagttcatacttatgctctcattgtctttttgctcttacttgacatttttggtgaggcaatggggttaaagagccaaaaatgattccgttttggtgcttaatgccaaagggggagaaattaaggccaaaagcaaatggatcagccaaccacttgtgaattttgaaaataatagagtaagattttgcgacttgcccaaaacccttatattgcaaaatttggtcgcttatgggggagaattttgattatgggaaaaagggagaattttctggcacttgatcaattttactcttggaatatctctctatgtgcccaaacaagcgtgtttgacttagagataggaaaatgaatttaatttgcaaaaacaaaccaagtggtggcaaagagtgatccgaatatgccaaatcctaagttaaaagtatttggtcttcaatttgaattgatattacactcctcttgttgctttttgatgtgttggcataaatcaccaaaaaggggggattgaaagggaaatgtgcccttgggccatttgtataattgttttggtgattagatgcccaacaaaaatgttttgaacccttatgtgctaagtgaacaagaagtgcaaatcaaagacaaggtatgtttctagactcagtaaattgtttttaagtactaacatgtttgtccaagtgttagaaacagtgcagagaaaagagaaacgaatatggaaaaggattggctgtgagcagccaacatcagctcgggcctggcacaccggactatccggtgcgccaggctggccgacggtgaaccgactgctctcgggaaaacgacaaaggcgtatggctaaaattcatcggactgcccggtggtgcaccggactgtccggtgagccaacggcgccagtggccaacggtcgaccgtgcgatcaatgcgtgacacgtggcccgtgtcaacggtcggttgggcacaccagactgtccggtgcgccaactggtcccgaggaccaacgatcggatgcgctatatatggaaggggatcacgcaccggactgctacagtgactgtccggtggtgcaccggactgtccggtgcaccactcgacaaaaggcaagattggccttccaagttggcctccaacggctcctagctgtctcggggctataaaagggatccctaggcgcatggagcaagtaactaagcttacaagaaacatcctaaggcacctagactctgcactcacgcattctaatcatagttcttgagatttgagcactttcgagttgtaaactcttcacgctgtgttgtgtactcacctcttcacgtgtgtgcgtgattttgctgcgaacttgagtcttgtgtgcgttgatttccctcccttactcatgtgcttcttggtgatctctattgtaagggcgagagactccaaattgtggagattcctcgcaaccgggaaaaatactctaaaggaaaagattgtggtattcaagttgatcattggatcacttgaaaggggttgagtgcaaccctcgtccattgggacgccacaacgtggaagtaggcaagtgttacttggttgaaccacgagataaaaatcgcgtgtctcatgtgttgcttcttgtgattattttgaccacacgagcgtgtttcatagccacctgatttcactaacaccttgataatcaaatttgtggctatttagtgtttcaatttacaggatcacctattcaccccctctaggtgctctcaataaccaagcaaaaagcactcgtccactttaggagcaaactttgagctcttggattttttgttaagaattaaatatctacaactaaaaacttagaaataatcaaccttaggcttgttggtagtgagaagctcataggccgtcttcttgtagatcttgtggagataaagatggttgattgcatgacacgcgatgttgacagctttggcccaatatgtgtccggtgtattgtaccactgtccttgtgacctcaatgaaagtttggttcttccctctccaaaacaccattttgttgtggagtgtatggaaccgaaaattcatgcttgatgccttcttcacttaggtagtcttcaacacccgagttcttgaactccatttcgtcgtcgcttctcacttttctggatcttcaactcaaactcatttttgagcttgcctcttgaactttctacggagaacaaagtttgaagaagaagaaaaatgatcgatggagaccaaacgaagaatccacctcttaacaagggttcatctttcattttctacatctcatatgtgctttggttgctaatgagaatgatagtgaaagcgaaagtagggatgaggagggacatgaaaatggtagtgatgatgaggatgatcttcaacaattcttcgctcaacaatgcaagatgaacaagatgatcttgcttaaactcatgagaagagcggaagaacaacaagaaatatttcataagcaagaagacatcctcatcaacaagaccaaaatattagataagttgatcaaagaatatgaggagctaaagtgctctcatgatgatttggtccaaaggtatgaagccatgtccattgagcaaaatagaattattaactctttatcatgcattgctcaattagaagatgaaaattatatgctcaagaacacagtagaaaagctaaaaattgataatctagctttgcaagaaaaacatgatatgttgctatgctcacatgaaaagtttataaatgaacatatcatgctagtcattgctcatgaggttgttctcactagtttaaattcatatcaacctcacacatgcacgtgtgttgaaattgaaactatattatcatgtgctaacaaatgttgctcttaagaaagccaatcttccattgagctagaatttttaggaacaagtaatgtttcctatgcaaaagaaaacaatgagctcaagaaagaaaatgagtggctaagaaggagcttaactcatttaaagggaaagtgtcatgctcaaccttttcaagataattgtgatgacatggtgaaaaagcttgtgaatggggcaaccgtagcatgctcaaaacccttcaaaagagtatcaagcttttcaagaaaggcatgagcaaaattcaaggtgagaaaattaatgctcatattatatgctctaacaatgtacctatgtgtttcaacaaagaaagatcagagagaagagataagaggtgctatggatgcaaggagaagtacccataaacaaagaagtaacaagcaaaaggcaaataccttgcaaggacaagcaacatatttgctacatatgtcacaaaagggacacctatgcaaggattgtcccatgaatgggtaccaaaatatgtttgaaagaatttgtaggtacccagagatgatatgaagcttttgggtgcttgagtggtttaactcaatctttatctcaagctatcaatcttacattatctattctttaagattgacccaaagatgaattgaattgatgtatttataacttcatattcatctcgagcaagatcttatgttgtagggaccaaaggatttaccttcatggaaatcaaacaaaagacctataactaagggatatctaaaggacagtaacaattaaatctaaaagtgcacattgctttcaattagtatattcatttgtgtcttacgtaggcacataggaaaaatgaagcacttgaggatgaacttaaaagattctatcttgacttgaaaaagatccaatcacatggtagatctcatattcatcattcttatatgtggcaatccacatgctttaattggtgatgagtatttcttggcatatttcaaattgattcttattaatgccattatctaaacataaagaggattataccaagttcttaaatgaatagagtgctaagtaagaaattcaaattctcaagaacactttttaaaagggaaattctctatataactagagttgtgagactaatgtttctatccaagtgtttatgtagtctcacaacatgagaacgtgtttctcaaatggagtgtgccatttaacgttcaagaagatcaatccaatactatgtgatgtattccttcatgtctaaattggtttagaatcgtccacattaatcactcaccatgctatgaattaaacctgccatgtaaacttaattaaataatcatgctatttcttatcttgtttaaattggtgttatgcatgatatttataagagtaatttagttcatatcaccaccgtggtcgatccctcctcgtcctcatgccccttgtccattccctcaccaccgtggtcgaaggcggcaacaaccatctttgggaggacggggggtgggggtgggggcaagcaggggaggacgggcgttccatgaggtctattcgaaacttggagggctgggaagactgaggggtcccagagccaagcacgtcgtgggttgcggcgccaaggtgggggagcacgggccaaggagacagaccctgaagacgacaacggtgggtgcagggaaatcacgagcgagaggcggggacatggtaatgttagaagtctacactgtacgtacttaataagtagtagagtaaagacataaataaagtttggtttgatacctaacttgtcatactttacctaacttttttttttgcctaagattagtttttcaattcgaacgactaaccttagtcaaagtgtggcatatttagacaccaaccaaacagcccccaagtttgtcccctccccggcttttgcactccccgcaaccaccgtggtagaccgagtccaccgttccaatccctacgccaacgctaaccatcacgaccgtagcttctattcagaagcacggatctcaaagcaagcagcaacaccgccaaaccctaaacaccaaagccccgcatataaataccttcccctcccatcttttcccctctcctgccgccgccgccgctcccgctcccagctcgtgttccgcttcttgcagccgtcgccgcgaagcgctccagagaacttccgtcaac

SEQ ID NO: 341 - DNA, 10000 bp, Zea mays
atggtgggagattaagcggtgtcacaagcactggccacatactgtactgggtactcatgttgccaaatggattgaatccatcggtagctaagactagcctcaggttcctcggatcatttgcaaaacctgggtactttcggtcaaagtccttccacgcttccccgtcagctggatggctcatcacattggcgactggcttcctcactttcttgtgccattgtgtttcctctgaagtttgttttgaagcaaaaattcttttcaaccttggcaacagtggaaaatgcctcaaaaccttatgtggaacccgcttcgaaccagtttcatctttccatctagactccgtgcatactgggcactcattcaatttagcattaacattctgaaacaacacacaattgttcttgcacacatggatgttttcgtatccaatgcccaattctttaagatatttcatggcctcattatatgattttggcaactcactgttagggtatccatcggacatcagcttcatcattgctgaaaatgttgtattgctgattcgataacgagacttcatatacaacatcctcaccataaaagaaaattttgaatggctagaacccagactaagtgccttctttgaatctccaagaactcctgcaaatcttggctcttctccatcagcctctgccgctgcaaacagttcaccgatcatctcaggtactccatgatcatcatcgtaaacatcatcgtccacatccatatgtatcccaaagtcattatcatatccttcgacatcctcctctataccctcaacttctgtatctgctgactccccatgatgaatccacctcgtgtatgtagctgacattccataaatgtgtatatgagtttctacttcactctgaggtcgcaacctttgattaagacaattcacgcacggacaacgaatgtttgtgtcttctgggtatctttcagtaacaaaattcatgaactcttcaactccttttcacatatggcaggtgtgaattgtttcccataaacccatcttctatccatctattttgacaataaattaaaacttgcattaactccataactatgactacattgaaacaaaattgaaaaccacatcaaacacatgcatatatgaaataaaattcaaatgcacatggaaccttattgtcaaaaacacaacacatcaaaccttgtcttttctccccgcccttgccgctgttctgtccacgcccgccgtagctctgcgcaagacgccgctgctttgccgcgcccgaagcttctctgcctcgctgtttgcagacgacgtcgttcttccaacacagttggatcaatggatcaggcgacaagatcgctcgttcgctgcgacgctacccagttgccgatcaagcggacgacgacagacgccggcgtcgttgtgtgccgtaacctgacgggcgatcgcagaagcgcagatcgcagcaggaaaaatcagaacaggcgaacagccatgcagatcgcagaatggcggctgggaaaacctgttaacataacgacagatgggaacacctgttaacagatggatactttctttatatacaagaacaagtgcgtagtctggtggtagcaactatttaaaacaagtcgcaggtccctggttcgaagctccgcgggcacaacttttttttgccaaataactaactgccgcttccagtactgggccgggtccgcgtcgccaggtgggggctgtggcccaaaaaactgcggcccatgtaggccaaggatcccacgccgtcaagtggtgtgtacacgtgggccgttttttactaaaactcatctgtgaccaatttatttcatcattacgtcagccgatcaagccaaattaatctgtgacgttcctttcattttcgtcgacgttcctttcattttcgtctttaatattcaagtctaatcttcgtcccttgtaattgttgacgaagatgtaaatttggtcatagaaatgtatcaatctgtgaccgaagtcaccagcgtcactagaaaatcgtcactgatgatcacatttttactagtgtatattgtctgttatctcaccaatattgtctgtcatcaaatcgtggtgataactcattttgcttagcaagtctatatgcatccaaatctacttcaacatgtaacatgacctcttgcctatataataactcagattctcaaaacgagtaactctagaagcaccatgtctagaaacacaatatgctcatagagcttcggacaaaacctcatgccaacctccttagatcatccttaatttcttttgataagcttgatcaaagtcttgttgctaagcttagcttggccattggattgagcatagtgtgtagatgaattgagaaacttggtcttgtataatttgacaatatctcatacctctttgggtacaaatgatgttccttgatccatagttaatgtttgagggatgtagaatttatgaatgatatgctcaataataaactaaaatatctccttgtgtgttatattcatcaaaggaacaatcgcaatctagctaatgaagtaatctgtagcaaccaagataaagtgatgcccctttaatgatgggggatgaatttggccaatcaagtatagcccccaaccattggatgacacatctaaacatttaaattttcttactgcactattagaaaggaatcaccaaagggctcaacatgttttacctctataaattgcaatatttctaactcaaataaaagagttctatattcggtttgattgttgatgcactagtaatttaatcggcttaacatcccaaattcaaaaccgttaggaaaaataataactatacaaataccttgattttctttacaagccgatccatcgaaataaaacttccattaggtagaagtagagattttgtttccggtttctatagtacaacattgaacaatgattaggagatagcctagatgggtataccccatgcgaagaaatactatcaaagctagactaaccaacttttaaaaccatcctggctgactctaattgttttgagtcaaataaaagcaataacatcgggttttctttgatggagaagttacgcaaaccaacgtcaaagcaagatgtctattaagccgacatgttagccttataactctcgtgccttggcacatgccatatttgaaatttggtaagaataatatcaaggcatgtataaagatagatattgagtggcacacctaaccattgaaattaattatgtggccacttactgcactatagattacaatatttccaagtcaaataaaggagcttcatatttgcttgattattaatacaatagtaatccaatcgctttaacatctctagttcagaaccattaggaggaataataactagcatcgaaataaagctttcatgggatgcatagaagcaaggattttctttccggtttgtacagtacaacaacgttggacaacaattttgctttcgtatatacttgctgcacccgtccacagttctcgtttgagacgccacagggcagaggcggtggaggttggcaggtcaccaccacccggccttgtgtggtgtgcgaagtcttttactgaaactcgtcaaccctaagggcttgttcggttctaccccaatccatatggattgagggggattgagggggtttcaatccctagtaagtcaaaatcccttccaatccgtatcaatccccttcaatccatatggattgtaaataaccgaacaagccctaattgggcatgcactaccggccggcactcaccgcgcatcaacagctcccatgcaagctccagtccagtccctttcgaattttggcttgcccatctcgcccaagttcatcatgcgaccgtgcttccgggaatgcacagtgcagggtgaccctgtgcgggcggcactcgatccgatcgcgccgaactctgcatttcgggaaggaaagcgtttcagaactcctgctgtccatttgacttcgctctgcagagtgacttggctccaacaaacaactaagatgatgaccttccgcttaagttccgagtcagagctgtgaagaacagcattacttttgtcgccgcaatatatagtgtttggatggatggatgaggaatgatgaagagggatggggtgggatcattttaacttgactcatgtttggtttgaaggttcaaagttagggtcaagaaacattcttcaaaaataatggacgaggtcatttctcaaaaaataagggacggggtcaacctaaggttgatcctgttccatccctcgttgacaccgaatcaaacacattagttgcttacatgagtggcttttatctggtaagtctggctctgattaacctgactgagtgcatgtagtctagcgtgtttggttgtatgtatatggccagttttagagatgttgtttggttacttgcattaatacttgttgtataagttaaaaagtgttaaataaacgaaaatctattaatagatattaattatatgttaaaattatttaatacacactaattatatgtttattttgattcttttgaaaaagccgttttcttgaccaaatttaaattttatattttcaaattttaaaccgagacacactgaaaaacggacttgttttcgtttcccagtaacaggaatgggaaattttaccgttttttcggtgaaaaccgagcgagatatccaccactcgtcgggatccaaccaaccaaacaaacacgggtttttggatgagcaagaaaccaaccaaacgcccccatagtaactttatttgtagctagggtattgagaatgcaagatcctacacttgcatgcccgcccgttgttttgcggctgcagaaaattaggcacacggcacagccggggccgtgtggggctgggaccagccgagcagcacacaccaatgcaagagtggtgtgtggcctgactagctgtgtcactggaagctatagcttcttttgttcgttcaatcactggtcatgatggccgggccccggtgatgagttgtctgcctctgccctcgcgcgcacgtgtgaataatgcatggtggtccggccagcggcaccaaatgcatttcagcgtccgcgatggagagaagaaggcgcgcgctgacgccgatcgagcgccgggcggggaggccgcacgcgcgcgcggcgcgtaaaaggccgggtgtggtcgcgtcgtccgatccctccagtactcccgttgatcgggtcactcgggagaagctaacgccatgtgccggatcggactcggcggcggtctggtcaggacatcgacatctcgtcgatcccaccgccggatccgagcgcgcgcgccgccgccacgttgcctgcctctcatgacttgcgaccggaaaggaaagagacgtgcatggcgaatcgaagacctgcgcgcctcgaacgatccgggctggctgggaaaccggccggtttcgacggcgaatccaccggcgcgatgcgcgcccggtgaggcggcggccggcggggacagggacagcgcagtggcagccgttagctttcccgggtggccgtgtgaacgacgctttgctctcgcctgatctgttgtgtaagagtgcgtttggttgcaatgacaggacgagatgggatgggacgatcactcaaattaggttgtttggttctgggttaagggttgggacaggactatcccagtgttatcccctgttgtctctcaaaattggagggacgagagaggacgccaggtgacgtccctgtcctagctgacctgcaaacaaacacatcctaagatcacgctggatcgtcaacacaagctttctactagggatggcatgcagtgatatggtttcggatcacaacgctagagcagaaagttggccatgccgggtctatcgccgactaattttttttttgtgtcagcatgaaagttgtactgacatgtacatgtacgcagagtgtactgtgctctgacataaactcaacttggcagttgtttctagccggggtcctatcatttttaggaccacaagccaacaaatgataggttctctagactatataaaattctttatgatatatataatatacgtttattttacctgcaaaacaaaaaaatacactggtatatttaatttaacatgtctgataattatcgaggaataaagtcaaccaaaataacaatatatttatactttggagctaatatgattaccttaataaagaatagaacttcagtacatccattatttctcataaaaatatacttcttcggcaacatctaagagctaaccagaaaagaagtaattatttcactggagatgaaagtttacgatgttagatgctagataaataaagaaatgaactgctaaaaaatataggagctgcgagcctgccactagagatgacaatgagggtgagaccggcttcgtgcagcattgcaggaggccttcaatcggtgctctagcccgacgtgtgggaccactgcttctgtgcgtttcgacaagacgacaactaacaatatcattgctgttctattatattctattaaactttgggcctatctcctttttggaaccccgaggttcgcctctattgctagggctggccttggttgtttcacggtatgcaagtgacaagtgtggtgcactagacgtgtttgctttctgggctcgcgaggttaggccaggttgacagacacaagaaacccaacattctaaacaatatctgacaaccaatatgacttcgacatagttactgttggaagttaaattgacttccgatagctaatcctaggattgttggaagttaacgtcaggaagacatcgaaagatatcaaatataagagatacaccattgttctcgcagccagttgctcatgtttgtctctcgcacgtcagtcacaagaggtcgatatacatgtatcatcatgtattacatgtttagtctcattgtatattttagatggatttctttagaggccctaattcatgggatgttctttaagatggcttactgtttatctggctctatatttgattaatagcatggataataatggtggtttttggtccgttgtcatgtctttagccatgcacgtagcctgcatcgctctagagtaacaaccgattcaaatatatttagacaactttactctcttcatcgatgacttttaatgcattattattttcattaaatatgataataacctatccagagaagccaatcggcgtaaccaacatagaccgattcacgcgatctagttgaaatttaacatataatttattttcgtgcttctagagtgatctaccaacatgagcacaactttcacttgcaggtcaagccaggtggcatgcctataacctctcatacttagagtcgcaatgggtagtgacgaccgtaacaacaacacactttttaactccacgtgtgccggctcccggacaacttacagtcgtttcctggtcgataatcttccagaatcaaatgtggattattatatagatgtccatagatataatactattgcatgattttaacttcatacgagaaagatatgattattttaagaaatgccttttgaaataaggttttatggaaacaaatatgaacatgagatgcaaaaccaacactcatcgcgggtggtggttattgaggggttgtgtggatatgcattagttggatcatcaagatctaaactaaaaacaaactaaattaacaattagacttagctctagaaaaacgggaaatatgtagaaaattcccaaaacattttaatcgatgtttaaatatgttccaaaaactttccacactaaaaacacaagatgcaaccatcatgtatgtataaacattaaatgtatattatatttttttgatttcatcttatacttttattatagaaagttttagaatgcatgtagacatcaaacatgaagttttgggatatttccagacattagatattttttccctcaagctggtcaacttttttataagcttccaaatttatttttcacgagttataaatattttattttagtttttcttatcctacactatctcttgaattcttctaagattttcataagtttagagatatttttttgtaaattaaaacttcataagctattgagtagattttaactataaaaagatgaaacatgcttgaaaaacatttctaacttggtaggaaaggtaatttgaacaatctagaagttgacagatgagatgacatgttttaaacaagatagttcatagttcatgaaggtgaaagtagaaataacttttttctaggtgtcgtttgattcacatattggtaatgtaatgtgcaacacataatattaaattatgtttgtttaagtccaaccgtaatcgatactacacattaaatggatatcggtttattcaaacttgttatcccatgtattcgagtgtaaataattagcattaccatttacgttacattgcgtgaaccaaacgacaccctaattgcgccctaaaacggctatgggctgattgttaagcctaaagcccacaatgcagtttcgggcccaaaagaggccacttcgccgccagccagctagccagcccaagtgtccaatgcacgaactgatataagaaaccctagcggagccactaacacagtcgcctccttcctgcgccgccgccgccgccgccgccgctaccaccgcctcgcggccgcctgcggctccgcgtttccgcacggaaggtatggcaaccgtcaaaaccttctcactttgtgttcttgccttggactagcttacgcgttcgcgttatctcttgttgtcgctggaaacgtccctaatttcattcccatgttctgatggttttggtcattagatggtttcgttgttgcatctgtaggtgattaggtgtgactgtagtcactgtcatgcaggtaagtacgtccagttgagttttgagttggctgtttgtgtttagctttcccttaccagggacgtatcgaagcaccatactgagtgtctgagacgctatagctgtttcaatcgcgtatattgttttgtgcgtcctatatggattaaggaaccctctttgcagcagagatttgttacgtgttctgctgccagtagtcgcatggcagtttaatctttcgagttctgaaagatgttggtttcttaggtgtttgggagatccttctgaatcgaagcacacgcactcaggtgctatggcctttggcatttcatagttgcctatttaattggtgtgcgagatgcaccaggatagcacccttgcggcagaaactcacttttggttgcttttctgctgcctgtcaaaccctgatatttatttgctgcatatttacttggtttgattgatttccattgattttgcagtttttgtacttatatagttacgtggtcatatggtttctattgcacctgtagctgattagttgtagccagtagccactgtcttgcaagcagatagtcatagggaggtattatgcctttgcgatggctgtgttgcgatttaggattgctttctctgggacggatcagagcacatgtactgtggcgatatatctgttttaatagtgtagttgccaatttttctgtctgtgctatatggacaagggaacccgctttgcggcagagatttgttctgtatttctgctgccagtagtcacccaacagctaaatctttttggtttgagttgctatggcttttgacatttcatatttgcctatttcattgatgtgcgagatgcaccaggatggcaggatagcacccatgcagcaggaaattagttttggttgtgtttcttctgcttttcaaatccttgaatttgtgtcgctgcaaacttataggtttctgctgcctgtcaagtcctggtttttgtgtggaagctagctttctttgttgcttaatatattgttacatgaacagctgcattgtctaatgtacatataatcaattctgatttatttctttggttcttgtaaaatatgtagttggtgaaggtttcttgaggctgagaac

SEQ ID NO: 342 - DNA, 8012 bp, Zea mays
tgcttctagttcttctatgcatcatagaaatttggctaggaaaaatgctatgcctagaagaaatattgttcatgttcctaggaaagtaatgaatgaaccttctacaatttattatgcttgcaatgcttccttttctatttgtagaaaggataagaaggtaattgctaggaaattgggtgccaaatataagggagatgagacttgcatttggatccctaagactattgtaactaaccttataggacccaacatgagttgggtacctaagacccaagcctaaatttgccttgcaagtttatgcatccgggggctcaagctggattatcgacagcggatgcacaaaccacatgacaggggagaagaggatgttctcttcctacgtcaagaacaaggatccctaagattcaatcatattcggtgatgggaaccaaggcaaggtgaaagagttaggaaaaattgctatttcatctgagcactctatttctaatgtgttcttagttgagtcgcttggatataacttgttgtctatgagtcaactgtgtaatatgggatataactgtttattcacaaatgtagatgtgtctgtctttagaagaagtgatggttcactagcgtttaagggtgtactagacggcaaactttatttagttgattttgcaaaagaggaggccggtctagatgcatgcttaattgctaagactagcatgggctggttgtggcatcgccgtttagcacatgtggggatgaagaaccttcacaagcttctaaagggagaacacatgataggtctaactaatgtaactttcgaaaaagatagaccttgtgcagcttgtcaagtaggtaaacaggtgggaagctctcatcatgccaaaaatgtgatgacaacatcaagacccctggagttacttcatatggatctcttcagacccgtcgcttatctaagtataggaggaagtaagtatggtcttgttatagttgatgatttttcccgcttcacttgggtattctttttgcaggataaatctgagacccaagggaccctcaagcgcttcctaaggagagcccaaaacgagtttgagctcaaagtgaagaagataaggagcgacaatgggtccgaattcaagaaccttcaagtagaggagtatcttgaggaggaagaaatcaagcacgagttctccgctccctacacaccacagcaaaatgatgtggtagagaggaagaacaggacgctactagacatggcgaggatgatgcttggtgaattcaagacgcccgaacggttttggacggaagccgtgagcacggcttgccacgccataaaccgggtctgccttcatcgcctcctcaagaagacttcttatgagcttctaactggtaacaaacccaatgtgtcttactttcgtgtatttgggagcaaatgttacattctagtgaagaagggtagaaattctaagtttgctcccaaagctgtagaagggtttttgctaggttatgactcaaatacaaaggcgtatagggtcttcaacaaatcatcgagtttggttgaagtctctagcaacgttgtatttgatgagactaatggctctccaagagagcaagttgttgatcttgatgatgtagatgaagaagacgttccaacggccgcaatgcgcaccatggcgattggagatgtgaggccactggaacaaaaggagcaagatcaaccttcttcctcaacaatggtgcatcccccaactcaagacgatgaacaggttaatcaagaagagacgtataataaagggggagcacaagatgatcatggaatggaggaagaagcgcaaccggcacctccaacccaagttcgaacgacaattcaaaggaatcatcccgtcgaccaaatattgggtgacataagcaagggagtaactactcgttctagattggttaatttttgtgaacattactcttttgtctcttctattgagcctttcagggtagaagaggccttgctagatccggactgggtgttggccatgcaggaggagctcaacaacttcaaaagaaatgaagtttggacactggtgtctcgtcccaaacaaaacgttgtgggaaccaagtgggtgttccgcaacaaacaagacgagcatggggtggtgacaaggaacaaggcacgacttgtggcaaaaggttatgcccaagtcgcaggtttggactttgaggagacttttgctcttgtggctaggctagagtcaattcgcatattgttagcctatgcccactcaccattcttcaggttgttccaaatggatgtgaagagcgctttcctcaacgggccaatcaaggaggaggtgtacatggagcaaccccctggctttgaggatgaacgataccccgaccacgtgtgtaagctctctaaggcgctctatggacttaagcaagccccaagagcatggtatgaatgccttagagactttttaattgctaatgcttttaaggttgggaaaaccgatccaactctatttactaagacttgtgatggtgacctttttgtgtgccaaatttatgttgatgacataatatttggttctactaaccaaaagtcttgtgaagagtttagcagggtgatgactcaaaagtttgagatgtcaatgatgggcgagttaagctacttccttgggttccaagtgaaacaactcaaggatgggaccttcatctcacaaacaaagtacacacaagacttgatcaagcggtttgggatgaagtacgccaagcccgcaaagactccaatgggaaccgacggacacaccgacctcaacaaaggaggtaagtctgttgatcaaaaggcataccggtctatgatagggtctttactttatttatgtgctagtagaccggatatcatgcttagtgtatgcatgtgtgctagatttcaatccgatccaagggagtgtcacctagtggtcgtgaagcgaattcttagatatttagtcgctatgccttgcttcgggatctggtatccaaaggggtctacctttgacttgattggatattcagactccgactatgctggatgtaaggtcaataggaagagtacatcggggacgtgccaattcttaggaaggtccctggtgtcatggagctctaagaaacaaacctccgttgccctatccaccgctgaggccgagtatgttgccgcaggacagtgttgcacgcaactactttggatgaggcaaaccctcatggactttggctacaatttgagcaaagtcccactcctatgtgataatgagagtgctatccgcatggcgaataatcctgttgaacacagccgcacaaagtacattgacatccggcatcactttttgagagaccaccagcaaaagggagatatcgaagtgtttcatgttagcaccgaaaaccagctagccgatatctttaccaagcctctagatgagtcgaccttttgcaagttgcgtagtgagctaaatgtcttagattcgcggaacctggattgatttatagcatacatgtgttttatgccttgatcatgttccttaatgcatattgttgtttatttatggtgctcaagttgtacaagcactccccggacctcacaagtccatttgcaagtgatgcacatatttagggggagatatgctacaacttgaccctttgagactaattgtgtacttgagtttgcttaacttagtctcaaaggaggtttgaaagggaaaaggtggacttggaccatgcaagacttccactgcacttcgatgaaagagtaactcattccaagttcatctatgtactcttattgcctttttactcttggttgaagattttggtgaggcaatggggttaaagggccaaatttgatccccattttggtgcttgatgccaaagggggagaaaataaggccaaagcaagaaatggatcagctaccacttgagaattttgaaaaagtagagttagagtttttgtttatgaaaatactctttgttgtctcttattgtctctttttgtcaaaagttagtctcttgtggggagaatgtttgattatgggaaaaagggggagtttatgaatctaaaagggggagtttatgaatctttgatcaatttctcgtggaatacctctgtttatgtctctacaagtgaatttgacttagagataggaaattgagtttgatttgcaaaaacaaaccaagtggtggcaaagaatgatccatatatgccaaatttgaatcaaaacaatcttgagttcttatttgaattgattttgcacttgttctacttgctttgtgttgtgttggcatgaatcaccaaaaagggggagattgaaagggaaatgtgcccttgggccatttctaagtattttgatgatttagtgtccaacacaagtgcctaagtgttaaaaggtggacaaagtacaaatcaagtataaaggtatgtttctaagacttagtatattgttttggagactaatgtattatgtctaagtgttggaaacagaaaaaaccaagttggaattaaagatggctttgttcagccgaagtcagctcagtctgggtgcaccggactgtccggtggtgcaccagacagtgtccggtggtgcaggctgactcaggcgaacttgctgctctcgggaaatcgttggtgacgtacggctataattcatcggactgtccggtgtgcaccggactgtccggtgagccaacagtcggcccagccaacggtcggccgcgtaatccgcgcgcgacgtgtggcaagagccaacggtcagaaggggcaccggactgtccggtgtgcaccggacagtgtccggtgcgccaacggctaggaatctgcaacggtcggcttcgccaaataaggaaagagatccgcaccggacagtgtccggtggtgcaccggactgtccggtgcgctaggcgacagaaggcaagaattgccttcctggaatgctctcaacggctcctagctgccttggggttataaaagagaccctaggcgcatggaggagaacaccaagcattctctaagcattgctaagcaccaagacttcgattccgcgcatttgattctttgtgatagcaactagagctccatttgagttgtgaactcgtcgggttgtgttgtgagctcttgttgtgacttgtgtgcgtgttggtactctgatttcgtgtcttgtgtgcgttgctcatccctcccttactccgtgcttctttgtgaacatcaaagtgtaagggcgagaggctccaagttgtgaagattcctcgcaagtgggatatagtaaagtgaaagcaaaacaccgtggtattcaagtgggtctttgaaccgcttgaaaggggtttattgcaaccctcgtccattgggacgccacaacgtggagtaggcaagtattggacttggccgaaccacgggataaaccactgtgccatttctgtgttgatctctttgtggttatcgtgttgtgcaagctctcctctctagccacttggcttaattgtgctaactcctaatcaagttttgtgaattaagtttcaagtttttacaggatcacctattcacccccctctaggtgctctcaagcggtccgactaaacaagagtgcgacatagcaatcacatgacacagccaagttagtacgacacaaataatgtgtcgagttgccggggcgcagccaatgctcagccgattaataatgtagtctgatcaacgtgtctgggtacccacaatatcatttaatcgctcgacgtgaggctaaaagctcaacacaacataaatatttagagcgatatgaaaatacgcaacatagccttcacatgcattttaataattttctactaattatttactacgggaaataaatgcagaaatataaacacaaaaattaatgcatgaacataacatattaggtgtaaaatgtattttcccatatttaaacacatatttttctactaattatttgcgactgaaaataattaattaaagtagaaaaatgctcaaactgccatttgcatgagatgctaaccgtttattggttgctgctcttttttctttttagctacacctaatagcatttaatcaggcaggaatgagattgcatgcaggctgtcatgcacacaataactaagggagcagacttcccaccttggtgcgtccgagggctaagtcactgggaccacacgttcaaagccacttaattaggatctctaactaacgcatgcagtcaaagattgcttttctttcagccacaacgtgtgcatgcatgcagtcaaagatccggcttcctctctgtctctgtgatcgccgcatagaccgcatgccaggccgttcactcggcctgcggatggcagccttgcccatccgcctgacgtcatggcggaagcttgcatgcccggcttgcgacggacctcgtttgcgcgcaagcgacagtcggggcaaagctcgctcgtgtggcatgcgtcggttgggacgaagctcgcccatgggtagcctgcagcgtggcattgagttgacctgcgtgtatcgtcgttacacgcagtcacggtgctgctaaagtttggtcgtgtggttcccgacgatcgcgatctgctctggcacaccaataccaaattcaacgtctgcagcaggcacatgcggcggcggccgacatgcacgcagtgcactatgtgtcgactcgagggtgaggcacgacgctgctggcgcggtctctagtggtggcgctagccacaccttgcgggagcaggtagatccattctactaacaaacaaaatcataccacacaatttggttgcgtagaggaatcggagtctatcgtgtaggacagttcggctaggccgtaagacctgccggcttgacagagagttgatgcagatctgatcccgtagcgacatcgaggtagagcgtgctgataacgtgttgaaatacgttactacggatcaccagatccgttcccttccctcccgttagcagattaggcgcgagaagatgtggatgacctgtatcccttcctataagcacaacagatagcacacgagacacatgatgtagggttggacctctgacctctttctcttctctatattataaggtggtatacaggtttattatatagagatgtgagactcctcaggggcaaagcaggtatttacccatataaccccaactaaggttagttgggctttgacatgtatttccccaaagtgcccgcgggcgtgtaactgaaccgaagcacccgttctcccgtttcaaatctatgtgggccggtccatatacagtccagccaacagacggttcacgatccggcgtgcaatcttcgttcagcccactgggagtggagtgactcactcgggtccattctataaaacctctgcccgggggctagggtttcctcccagccgtcatcgtttcgcgtccgcctcagcccgccgcaaggagaggtaaggtaagccgctctcctctcgccccatctctccactgtccggccgttgtggtctcagcattccgaattgtatgtacttctttgttgggtagccggctcggtcggttcgtggaacagccggatctgctctgtaagcgcttgttctggagaggtctttcggcgggagtgagagtcaaggtctcttatatttcgtgtatctgttcgtatcggtagcttttgctgttaatcgtgagaaggttttgtgggagggatctctttgaccttagtacgcccatctcatcgtggtaaggatgctgtctatgatttcaaatattattgccattgttgaattggaaatggcgctggtttactaatggtcttgctatgtttctgattttggctgggttaacgcctaaacttggctttcggttaacgctagaccgagtactgttatttgttaaccggtagcatttatgtagatgacaaaaccattctatggttcactacacaatttgcattattttgtcttgtctcctttgcttcttcacctatctgacattattttctttctttgtatgtttccagttcaggagacatcttcgagaagctgaa

SEQ ID NO: 343 - DNA, 8082 bp, Zea mays
cgctttgctttgtcgcgacgcgagcctgcgcgttgcgttcgtggcgtcggggagggggggggatggcaagcgccggtttgctgtattggtcacgtgatgcggctgcgcaacggccggggccagggcggtgccgccgcggcgacgggatcgcgcgtggttggtgtgacggacgggtgggggcgcaccgagcgcatgccgcctccatgaggattgaggaggccctcccgtccggatgcatcacacatgccactggcttggctggctgggacgtgatcccctgcaccggctacgtgttcttccttctcaccgagaagatgctgacaatgaaaacggcggcctcgtcacggctccgacgcgatccgtgggcgggcgggcgcgtccctcgccggagctggcgccgcgtgtcgccttctctggaacgccacgtgcctgcgtgcgcgcgcgcgcgcgagacgtcctagtccccagtgatttcgcttggaaattttttttatccgaatcttgagggtctggaggagcttcatggctaccgagtgcccgtcagcccgtggtatttttaggtgtgaacggagcccggttctcgtcggatcgccagctttaataagcacgaggtagtaggtgcgaagaggagaacggccttaactaactgctctcctcacgctgccaggaatgagcttgacgacggtgctagctggcacgaccttattaattttttattactatattactagaaaacgattgatcacggcgaaaattaagcactcgcctcatgacccgatcctccgaagccccttcgcatcacggcgctttgcggtgcttgtctttgacttcttcttttttttaaaaaaaaactcgcaatgggtagtacacacgatagccgcagtctttaaaagttgattactcttctcaatctgacctgacgtttggctcaagtcgaactcgagccgggaaaaaataaatatattagttaacaactaaaccctcctgtaaattaagcctaagtacctaggatacgtccctcctgcctctaactacttttttattactatctttattatcgatagaatctagggtgtgtttgtttagcgggttgacgcgggttggaacagattcaacacataacaactcgtgtttggtttaaaaggctcgcgggttagattggttccgggtcgaaatacgtcttgaaaatatgggttctaaggattcctaaaaacaagcgaaccatttcgacccacttcctctctaccctactgtcacccatgtcttatccactcgagaccagcacagggcgtgccgccactgtcgagggaccccgccgacctaccctccgacgttaatcccctgcctgccactagtcgtcggtcccccactggcctacccgccagcatgctggcctccgccagcgccgtcagactccctgaccggcttgttgcgcctcccaccgtcagactcctcggctggcatgccctccgatgtcgtggtgttctccgataggcacaacttgcgagccttgctagtgctgtcgtcgaacaggtaaaggtcagtgctcgtcatcgcctagacaagcctgctagtcatgtcaaatgttaaaaattcactgaaatgtatcttagtgttgttgggatgttcctttaactataactgaaatgtaacagtgagacctcatcactaaaaaattatgacttggttaataatggctttaatttatgtatatattgtgcttattgatttctcaaatattaaaatagtgtcgtttcatttattttgaatgttgtcatcttattgaattgaattgaagatatatcattttgggtaatatgaccagtaaggttactatattaagtttatccctcatcatgaaataaataagagatggtgtagctactatgagttctatgtctatctagtgtccatgccggacatgtttcgttgcatgcttaatagtagcgccgagagcgttccctcctcttctcgcaagcgtgcctgccaactttgaaaaaaaaaatatcttagatatacctttgctctttgctttgagcgcttgtattttgtccttctgtttcttctttaccgagttaagtgcttaactagcatttgtggcaatcaccatcgatcatctgatctatggctgcatctttcttcaatcttggatgtggacttgacctagcccacgcacaacgacacctgcagagtaactgttagcccactaattatctactaccaaacgcaaggttttcaaaatctcccctgtatatacatatatggctttcaatcccgcaaatagatacgttcattcataggagtacgcacgtgtgccgtgcacgagggtctcggtttataccgtcttcttttttttttgaagaagaaaaaaaataaacttgtcctaagcaggacgtacggtagcacctactgccaataagatatatattgctgctggtaaaatattttataatgtttatgatcttatcattgaaaatttcgtgtgaagtttttaaatttaaaattcaaattttataaacggtcttggatgtagaaactattaaaataaaacttttagatctcaaaaagttatgcaactttatagttggtcacattttcaaatgaactcatttagtgccttaaataatcaaattactctcgatttgttatagtacatgggaaatggaaacgtaatataaatataattggtgtaatagtgtagtgctatagaagggtatgcgcgagagagaggttgcgagttcgaatctcaccatttacaaaacatataagtttgattcaaaataatagtgaaaaatgatagggcaacgggtaagggtagggttggagagttgttcctagaatttaaaaaatgttttgctgttttttttttaatttttttgattcttaatttgccgagtgtttttctttgccgagtgctttttgacactcggcaaagtctttgccgagtgtccgaaaaaaacactcggcaaagaaccctttgccgatgaaatctttgtcgagtgttaagcctttgtcgagtgtaaaatagtctttgccgagtgtcttagacactcggcaaagaacgtgattccggtagtgaatagatacgttcattcataggagtacgcacgtgtgccgtgcaggagggtctcggtttacaccatgttctttttttagaagaaaaaaattaaacttgtcctaagcaggacgtacggtagcacctactgccaataagatatatattgctgctggtaaaatattttataatgtttatggctttataatgtttaaacttgtcctaatagctgacacatgacagactctaacctttcagtttccttgaaaagcagtaggccagcagccacaccccaggcgacagatggcgcgatcgtccacatggtggaggtggatagcagcaatccaggcttttccagtttggttccaaggcggcctccgtgtttttaattttacacacacatatatacatcctcctctcgttttcttcggccacttcttttttcttcttcttcttctttttgttgcacacatatatgtattccagggaaatttcccttggtgtgtgccatatacatgcatgtggaggagacggggatggagagctgtgagctagtcccctttgtactacagaaagaaagtgcgtgctgcccttatttctggaatgaaaaggcagaatgggaagagggggaaaaaaggggatagatagatgtggaggttgagggagacccacaccaccatataaacccccctcttccaaactagtcacacatggcacaagcacacagctcatcagttcttcttcgtcgtcttggctagctgcctagctagctagctagttcctcactcctctccgagaaccccctttttcatctctctctctctctctcggtctcgcccagctcctttcgatgttatcgtctctgctggcctcgcaactcgtcgagagagactcgtgaaaaagaatccagatatagctagagagaccgagagggcagctagcatgtcgatgagcttcttgagcatggtggaggcggagctgccgccggggttccggttccacccgagggacgacgagctcatctgcgactacctcgcgcccaagctcggcgccaagcccggcttctccggctgccgcccgcccatggtcgacgtcgacctcaacaaggtcgagccatgggatctccccggtgagtacgtacgtccacgcaagtagctagataaatcttttttttaatttgctagcgctcctttctttttctacgaccttcttctcagctaataaaagctagctagctgtgcgtcttccttgattaattcctccatgatacttgcaccaagttgatgcatatatgcgcacggagaggagaaagatgcagagaaatcacacacgtcaaatttccctagcttgctcgacacaacacgatccttaaatctgtccctgtttattatattctagtccacgatcaaaactcacagctttttccgtttttttaaataaaacacagcctcttaatttctgctgttttttttaaaaaaatcatgattttccagaataaagctatttgggatcgatcctctgttgcttcagcgtcaagagaaacaccacacgagtccccggccaaatgtgctgttcatacactaaactgctgcacacacatcacaccactctcctacatacttttatttttcgtcagcaagctagctaggatattaatatcgacgttttgctacctaaacctttagaaataattcatgatcgatctcgttttcatgcctatatatgatcatttccttgtcttcctcttcactcggtatatgttttctatacctcttctttttgttaccatgaacttgacttgttgatgacgcctccccaacaaatgaatagttatgaccagctgtattttaagtcggaggtcaaactaaaattaagcagtaggtatacacacaccattaattaattgaaaaacacatcgatttaatttgttttccgttcgtcggctgtaattatccaatttgtacacgatggtttctttgtttgtttctgaaaccttctcgcgcgcgcggtggtataatatcaacgtcacgatcagagtacgcgtgtacacgtactgcgctctcgatatgcacaagaccacactaacaaagctagccaagcgtccgtcgtttggacgagctttttgccaatctaaaaagaagagtaaatttaatttgaatcatttggggtggttcatctaaattcaccgcgaggaacgacaaccctctgctatatggtatatctctcgatttgtttaagctggtgaagccgtcctgctgcctgccaaatagatagactctagcaactactgagttttaaaaagagaaacaaaattaaagaatgacaaccttttacggccaaaccccttttaacgtctggccaacgaatcttctcttcgacctgttttagcttgtgtccaaaatgctttccgtcgtagccctgcgttcgttactagataccgctcaccatttgatcttgattatgaaaacattgaccttatatatatatatatatatatatagccaagtattttttaatctaatatggaataagagaaaaactaatgtgcgtgcaactatcagaagcaaaattttctgtttttttcttctaacattgttgggtaaattagaattcaaaattttatgtatcggtatactatatattataataccctccagctcagattcaaatccgttttagataattaatagattcatacaacacttaatggtgtgtgtacatgttttatacacgtgtctagattcattatcatctatttgaatatagtagacataaaaatcaagatcaaaaccgaatactactttagcacggagtgagtaaaagtataagtataatattttttggggatatttgggatttttttaattttgattacacgacgattatattatattgtacggccggggaagcgttgattgtgcacagactgcatgccgtacaaactgcaagaataatcgtacatgtacatgcatgctgatgaactgaaagatcttgagctcgtggccctcctaatttgttaaataaaaatgcacatcggaaagcaacaaactgcaaatcacgccttacgcatgagatctcagattcccagcacgctctctctctctctctctgtctgcacatcacgtcacgtgtccctcccctcttgtgaattgatgcccggatcagcacactactggtagcagaaggtcccaaaactaagctatgcatgggcgggctacatacatacaccacccccatgctatttctagcagagtggctccaaacctcagcatccacagtacaggctacagcgtgtggttgtgatggtgaccacaagaatcctactacatgcatgctgatgatgtgctgcagtgaacactcactcactgcccatgaacagcgtctcctacctgccagccagtgccaagaacaatgaatgaatgattaactgctggcttcgcttgctgaaccattcccctcctcgtgtgcgcatgatgggcatgcagtggcggcgtcggtggggccgcgggagtggtacttcttcagcctcaaggaccgcaagtacgcgacggggcagcggacgaaccgggccacggtgtccgggtactggaaggcgacggggaaggaccgaccagtggtggcggcgcggcgaggcgcgctggtggggatgcgcaagacgctcgtgttctaccaggggagggcgcccaagggcaggaagacggagtgggtgatgcacgagtacaggatggagccagctgctcctcttcttgatcaccaaccctcctcatccaactccaaggtaaaatcggtcgatccattattcgatgaaacgacaagttaagactccattaattcgacgaactgaccgggggtgttttaactgtttcgttgtcgtccatcgatccttctcctgtcatcatgtcaccagcaggatgaagattgggtgctgtgcagagtcatctgcaagaagaaactggcagcaggaggccgcgcaggagggggcagctcgaggagcctggtcgccagcaacggcggccgcgagaccgcgccagccaccccgccgccgccgccgctgccacctcgcatggacacggacgccaccctagcacagctccaggccgccatgcacgccaccgccggcgcgctcgagcaggtgccctgcttctccagcttcaacaacaacactgccagctctagagctgctgccgcagcagcagcagcgcagccatgctacctgcccagcatggccacaggcggcagccacggcacgacgagctactacctagaccacgcgatgctgccgcctgagctgggtggctgcttcgatcctctccacggcgacaagaagctgctcaaggcggtgctgggccagctcggcggcgacgcggtggcgccgggcctgagcctgcagcacgagatggccgcgggcgctgtcgtcgcttcatccgcttggatgaatcacttctaggggacattagttcagcagcgaacctaagtatgtgattggttgcgtatattatgggaaatacatacatatatacataattgtgtggtgaaacatttgtgtgtgaggcaaggagtagagcatgcgtcatttttttggttgctgccgatcgatttggacgaaggccatgaggcaaggagtagaactctgtaatataatgatggctgctcaagtgtgtgtacacattcagatgcagaggtcgtatgtcatgagcgatgatcaggagaatttcagattggttattttactgtgcctgaactcaaccccaagatcacacttgacaccactcactcactcactcactcagagacacagtgcacattcatagaatcatcatggtaaacagacagaagacagaacagtggctgccaaacccaatcaatcatgccatttatgcaggaaagtaggcatgacagtcacatccgagcatctcttctttaccacaccatctttctttttccgatgtgtattgttgcgatgacaatcatgctaaccaagcagtcagctgagtgagggctcctgggcactggctttccactgcact

SEQ ID NO: 344 - DNA, 4672 bp, Artificial Sequence
  PHV00002
gaagttcctattccgaagttcctattcttcaaaaagtataggaacttcggtaccaaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagggaagttcctattccgaagttcctattctctagaaagtataggaacttcagatccaccgggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccctagcgcaactttgtatagaaaagttgggccgaattcgagctcggtacggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagagtcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgctatacgaagttcctattccgaagttcctattcttcaaaaagtataggaacttctgtacacctgagcaacattaagttatgacgaagaagaacggaaacgccttaaac

SEQ ID NO: 345 - DNA, 9291 bp, Artificial Sequence
  PHV00003
gaagttcctattccgaagttcctattcttcaaaaagtataggaacttcggtaccaaacaagtatgttttataattattttgatcttgatatacttggatgatggcatatgcagcagctatatgtggatttttttagccctgccttcatggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgttattctaataaacgctcttttctcttaggtttacccgccaatatatcctgtcaaacactgatagtttaaactgaaggcgggaaacgacaatctgatcatgagccttaagcttgatatcatgataagaaaacatactagacattaataatctgctagaaatgggaagaatcacgcgtaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccaacaatgccccagttcgacatcctctgcaagaccccccccaaggtgctcgtgaggcagttcgtggagaggttcgagaggccctccggcgagaagatcgccctctgcgccgccgagctcacctacctctgctggatgatcacccacaacggcaccgccattaagagggccaccttcatgtcatacaacaccatcatctccaactccctctccttcgacatcgtgaacaagtccctccagttcaaatacaagacccagaaggccaccatcctcgaggcctccctcaagaagctcatccccgcctgggagttcaccatcatcccctactacggccagaagcaccagtccgacatcaccgacatcgtgtcatccctccagcttcagttcgagtcctccgaggaggctgacaagggcaactcccactccaagaagatgctgaaggccctcctctccgagggcgagtccatctgggagatcaccgagaagatcctcaactccttcgagtacacctccaggttcactaagaccaagaccctctaccagttcctcttcctcgccaccttcatcaactgcggcaggttctcagacatcaagaacgtggaccccaagtccttcaagctcgtgcagaacaagtacctaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtgtcatcatccagtgcctcgtgaccgagaccaagacctccgtgtccaggcacatctacttcttctccgctcgcggcaggatcgaccccctcgtgtacctcgacgagttcctcaggaactcagagcccgtgctcaagagggtgaacaggaccggcaactcctcctccaacaagcaggagtaccagctcctcaaggacaacctcgtgaggtcctacaacaaggccctcaagaagaacgccccctactccatcttcgccatcaagaacggccccaagtcccacatcggtaggcacctcatgacctccttcctctcaatgaagggcctcaccgagctcaccaacgtggtgggcaactggtccgacaagagggcctccgccgtggccaggaccacctacacccaccagatcaccgccatccccgaccactacttcgccctcgtgtcaaggtactacgcctacgaccccatctccaaggagatgatcgccctcaaggacgagactaaccccatcgaggagtggcagcacatcgagcagctcaagggctccgccgagggctccatcaggtaccccgcctggaacggcatcatctcccaggaggtgctcgactacctctcctcctacatcaacaggaggatctgagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcggtcacaccggttaaaaccaaaatccagtggcgagctctcgagtcgatcgctatggccgaattcgagctcggtacggccagaatggcccggaccgggttaccacgctatttatttgcttggtactgtttcttttgtcgatgctcaccctgttgtttggtgttacttctgcaggtcgactttaacttagcctagggaagttcctattccgaagttcctattctctagaaagtataggaacttcagatccaccgggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccctagcgcaactttgtatagaaaagttgggccgaattcgagctcggtacggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgacgaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagagaggatccagtcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgctatacgaagttcctattccgaagttcctattcttcaaaaagtataggaacttctgtacacctgagcaacatctaactaactaggacgtcccgaggtccgattccgggctaattaacacctagctcgccactcgactaattagggactaagcctagcgcttagccgttaaaacctagcacaccctaagcacccttagttaggttcccctcttaattaagccctagtgagcccctaagttaaggggacgctaagagccccctaacctagtattcggctagaggcgaactaggctaaacacctaagcgcacctctttaagctagatcgctagggggctaggctagagcttcgctagattagtctaagggcagctaactaactaggtttaaactacattaaaaacgtccgcaatgtgttattaagttgtctaagcgtcaattttaagttatgacgaagaaggtttacaccacaatatatcctgccaaacggaaacgccttaaac

SEQ ID NO: 346 - DNA, 3757 bp, Artificial Sequence
  PHV00004
agggggatgtgctgcaaggcgattaagttgggtaacgccagggttttcccagtcacgacgttgtaaaacgacggccagtgccaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaacaatgccccagttcgacatcctctgcaagaccccccccaaggtgctcgtgaggcagttcgtggagaggttcgagaggccctccggcgagaagatcgccctctgcgccgccgagctcacctacctctgctggatgatcacccacaacggcaccgccattaagagggccaccttcatgtcatacaacaccatcatctccaactccctctccttcgacatcgtgaacaagtccctccagttcaaatacaagacccagaaggccaccatcctcgaggcctccctcaagaagctcatccccgcctgggagttcaccatcatcccctactacggccagaagcaccagtccgacatcaccgacatcgtgtcatccctccagcttcagttcgagtcctccgaggaggctgacaagggcaactcccactccaagaagatgctgaaggccctcctctccgagggcgagtccatctgggagatcaccgagaagatcctcaactccttcgagtacacctccaggttcactaagaccaagaccctctaccagttcctcttcctcgccaccttcatcaactgcggcaggttctcagacatcaagaacgtggaccccaagtccttcaagctcgtgcagaacaagtacctcggcgtgatcatccagtgcctcgtgaccgagaccaagacctccgtgtccaggcacatctacttcttctccgctcgcggcaggatcgaccccctcgtgtacctcgacgagttcctcaggaactcagagcccgtgctcaagagggtgaacaggaccggcaactcctcctccaacaagcaggagtaccagctcctcaaggacaacctcgtgaggtcctacaacaaggccctcaagaagaacgccccctactccatcttcgccatcaagaacggccccaagtcccacatcggtaggcacctcatgacctccttcctctcaatgaagggcctcaccgagctcaccaacgtggtgggcaactggtccgacaagagggcctccgccgtggccaggaccacctacacccaccagatcaccgccatccccgaccactacttcgccctcgtgtcaaggtactacgcctacgaccccatctccaaggagatgatcgccctcaaggacgagactaaccccatcgaggagtggcagcacatcgagcagctcaagggctccgccgagggctccatcaggtaccccgcctggaacggcatcatctcccaggaggtgctcgactacctctcctcctacatcaacaggaggatctgagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggccgccaccgcggtggagctcgaattcagtacattaaaaacgtccgcaatgtg

SEQ ID NO: 347 - DNA, 3296 bp, Artificial Sequence
  PHV00005
ttcggtacggccagaatggcccggaccgggttaccaagcggccgcatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagcaacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgaccgtcgacccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccagggcccggtgaccaatcgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaagtggccgttaacggatcggccagaatggcccggaccgaagccgaggccggcc

SEQ ID NO: 348 - DNA, 26569 bp, Artificial Sequence
  PHV00007
cggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttactaccggctggatggcggggccttgatcgtgcaccgccggcgtccggaggttaccggccagaatggcccggaccgaagactctcggtccgaagcttgcgatagcggccgcggtacctcactgactagctaatcgagctagttaccctatgaggtgacatgaagcgctcacggttactatgacggttagcttcacgactgttggtggcagtagcgtacgacttagctatagttccggacttacccaactttgtatagaaaagttgggccgagctcggtacggccagaatgataacttcgtatagcatacattatacgaagttatgcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggcccggccgctctagaactagtggatcccccagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgtacgtaacgtgcagtacgttttagagctagaaatagcaagttaaaataaggctagtccgttatcaacttgaaaaagtggcaccgagtcggtgctttttttttgcggccatcaagcttatcgataccgtcgacctcgagggggggcccggtacccagcttttgttccctttagtgagggttaattgcgcgcttggcgtaatcatggtggccgaagcttggtcacccggtccgggcctagaaggccagcttcaagtttgtacaaaaaagcaggctccggccagaatggcccggaccgggttaccgaattcgagctcggtaccctggtcacgtgcgtgtgtaactacagttcgcaaagcgacagaaggccaagacttgaagttttggccgggcgtcccgccatggcgacggcgagtcaacccgctgcccccacgcccaacggctacggcggtggtattttggctggcggagacggggtgcacgacactggcacggtgtcagatcagtctgggtcaccgtgagcctgtgtcgcagcactgctgctgttgcactgtggtagtgcggtggggctattgtcaaaggctcaaagcgtggctcggcagtcggcacccgcgcgatcagggcagccatcactcatcatcgcaggacatggcggtggagtggctacatagaaatctgtcctggtctgggcctgtgtagggtacgtacagctgaaatcagatccgccgcgtgtcaatttctgcttcgtttgacagtgtgtgcccacgccgcggagcgtgttcggtggcctttttcggcgttctagcggaatgggcgaccgcatttatcggctatgcttcattacataaaaccaaggctctgttttttagtacattagtagtaatgttcattgactgcgccgaactgtccgtatcatggcacagatgctcgttgatgacaacctcaacaggtggcagcgttacaacacgccatgcgacggtgtgttcccctcatgatgcgcaagttgcaggcagcaggtagcaaagcacatggttcactgggcacgaataggatgtttccatgccgacgtcctaatctcgtacagtacgtaatctctactacttaagtaagagtagtctaccattccatgttctatcaccattccctgttcttctgccattccttattctgcctctctcattcctattctctattctgcctttctcattcctcctccccgcacagcctatttccatattctgtcatttcctattctgcctttctcattccccctccccacaaagcatatttctattctcattcccgcgtacagcccacgtttagctaaaataaaaaaacacaaatgaccccaaagggattcaaacccgtgacctctcaaacaaatgcgagcagttgctaccgctacaccacatgtgtgtttatgtctacatctataacaggaaaaatatctactacatctctccccaaacctaccctactacccttgcacaatgcgtagtactagataagtatcatcgagattcttaaattatatttttagatggaatgagtaatatctaaagaagagccttgcatgcaatttcttttgtttgaataatgttttcaacttaaatttctttttttgcatgcgtggcatttattctccataatattttttccatggatctgacttgtgagtcattttcataaaccaacgccaaggataaatccatgtttcttgcttggaaaccacgaacaaacaccactagcaggaggcgctcacgttggcatcgctcatcgacgacgagaagaagcttgacgattgtcagttcgacctctggaagcagtcctacctggccgcatgaaccgctgtgtatgacaagctccgacacagccgccgcttggaatcggtccaaagcgactgcaccgcgttgtccatcgtcaagcagggggacctcatggttgttgccaacgtcggtgactctcgggttgttctgggcaccgcatccaacgacggagccatcacaccgtctagctcatcgtccatctgaagctcaacctgccatgtaagttgctactgaccggccataaattcttgtgcgctcggacgacggtcgttgctgatgttgtgtgagtgtcctcgaacatgatgtatgtagaggagtagcgcatccggtggtgcaacggtcaggtgtactaccttgctgatgaacccgaggtgcacttcatctggcagtccaaccaagagtcatcggcactcgacatgtcgcgcgcgttcgacgactactatactgtgacgtcatctcggcaccggaggtgacgcagaggaggaccgacatcaatgatcagttcttcatcctccccaccgtcggggtagctttttgtgctggtctgtctgtaattctctttacaaacacacacaattgctttttttgtttgagcaagcgcgtatggtggtacgtgcctgatgactgacgatgtacgagggaacttcttccggcaggcgtggggcatgctcaccaatgatgagaccatgaaaatcatggcatatatcgaagtcggtactgatggttgcaatgtagtggtgaaacaactagattaaaacaacaaaatttatgtatgaccagaatcacaaatagattatgaaacattttctcataacagtataacacacattttgtatataagttaccgtggtgttatatgtccccgttgcaacgcacgggcactcacctagtctatatagaaagaccctacaaagtagtacaaagactctattttattctggactcttccggatatacatgtacatgtgggccggcctggcccggcacggcacaggcccacaaaagcacggcccacaaaggcacggcccataaaagcacatatctaattatgggccgtgccgtgccagcacgtgtgcccagtcatcggcccacggcacggcccacaattagttatgtgtgccaggccggcccaaatagcccaaaataccttaatatgccagaccggctcatatacatacaacagtaatacatcaacaaaaagtaatatatatatatatatatatatatatatatatatatatatatgaccaaaataaaactaagatgttttatggatgcacattataaacctttggtcagaaagaaaaaaacaactagctcataaataatatttagttctctgtttagtgtttaattgagtactatacatccatacagaatacatatacaatgatcatcactattcactatccatatctaggtattggttctcgatggcttattgaagctctagattctccaaattatgctagtcatgtgggctttgacgaaccttagttaaatactgagtctatatttagtgggcctcggtgggccttagttaaatgggccgtgccaggccggcccgtgggcttgacatgaggcccaggcacggcccacaatgtgggccgtgccggcccaggcccacaattaggttgggccgtaccagatatgggtcgtgccagaaattgtatgattaggcacagcacaaatgtacacctatacttccggaatcccgaccatcccacggagccacctttcagaaccttccttcgccttccagaagcccacccgtcaccaccatataaaccgcccctgttcgcgtcggcattccccacaccgagaatcacaatacgaaacgaattaatccccaatcaacacagcaagtcagcaacaagcaaagcagcgacccgagagatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtacccaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgatccgatatcgatgggccctggccgaagcttggtcacccggtccgggcctagaaggccgatctcccgggcacccagctttcttgtacaaagtggcggatagatggcgtctagcatatcgataggacatgacaagtggtacgatccccgtcacatgtccatggaggcatctgatatggacacggcgtgtatctatcgcggctggaacagaaccagcgctcgcgcggcggtcggcgggagggacagaccttggctccgtgcgttcaggttgtgcttgtgccgcgcgccacgcacggtctccgccgcctgcagctgaaattttagatttacatcctatccctttattttttttatttgtcacaattcagttcaaaaatgaagaacggaggtagtgcatcctttgtgagactaatgaaaatcacatctggatcctgaaatcggcgtcgtaacctacaaggccacggactggattagatagtggtccatggtgcataatgaggatcgagggataacttcgtatagcatacattatacgaagttatggcgccgctagcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagggaagttcctattccgaagttcctattctctagaaagtataggaacttcagatccaccgggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccctagcgtatacgaagttcctattccgaagttcctattcttcaaaaagtataggaacttcgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtaccgaggccggccccgcgggagctcggcgcgccatgaggagcaatcattgttcaagacatgatgcaaagctagaaaactttgattgtggccgtcctaattgtgaagtttaggccggggggaacttcatgaaccctatcgaagcttaattagttcttttttgttgttagccatgtttgtattgtagtttaggtgaacaacatgacgccgcacccgcgatctcagggctcgtccccacacaggagggcacgtcgtcgtcttcgccgccgagcatcagagattcagagcacgtacacgcacatctcaagcaaacggagtagtacgtcctactcctacgtacatacctagccgacgacctttatgtgcacaccaccactgctctgctgcccggcctctccgtcgtccgttcatcaccagctggtctggtccttcaatttccatgcgtcggtccgcccggggattagaattaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcc

SEQ ID NO: 349 - DNA, 4358 bp, Artificial Sequence
  PHV00008
cgcggatagatggcgtctagcatatcgataggacatgacaagtggtacgatccccgtcacatgtccatggaggcatctgatatggacacggcgtgtatctatcgcggctggaacagaaccagcgctcgcgcggcggtcggcgggagggacagaccttggctccgtgcgttcaggttgtgcttgtgccgcgcgccacgcacggtctccgccgcctgcagctgaaattttagatttacatcctatccctttattttttttatttgtcacaattcagttcaaaaatgaagaacggaggtagtgcatcctttgtgagactaatgaaaatcacatctggatcctgaaatcggcgtcgtaacctacaaggccacggactggattagatagtggtccatggtgcataatgaggatcgagggataacttcgtatagcatacattatacgaagttatggcgccgctagcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagggaagttcctattccgaagttcctattctctagaaagtataggaacttcagatccaccgggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccctagcgtatacgaagttcctattccgaagttcctattcttcaaaaagtataggaacttcgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtaccgaggccggccccgcgggagctcggcgcgccatgaggagcaatcattgttcaagacatgatgcaaagctagaaaactttgattgtggccgtcctaattgtgaagtttaggccggggggaacttcatgaaccctatcgaagcttaattagttcttttttgttgttagccatgtttgtattgtagtttaggtgaacaacatgacgccgcacccgcgatctcagggctcgtccccacacaggagggcacgtcgtcgtcttcgccgccgagcatcagagattcagagcacgtacacgcacatctcaagcaaacggagtagtacgtcctactcctacgtacatacctagccgacgacctttatgtgcacaccaccactgctctgctgcccggcctctccgtcgtccgttcatcaccagctggtctggtccttcaatttccatgcgtcggtccgcc

SEQ ID NO: 350 - DNA, 20 bp, Artificial Sequence
  PAM-CGG
ggattccgcggaaatgggtg

SEQ ID NO: 351 - DNA, 19 bp, Artificial Sequence
  PAM-AGG
gtcaaggacatacgagacc

SEQ ID NO: 352 - DNA, 9380 bp, Artificial Sequence
  PHV00009
cagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagctcagatcagcttgcatgcctgcagg

SEQ ID NO: 353 - DNA, 3767 bp, Artificial Sequence
  PHV00010
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgtacgtaacgtgcagtacgttttagagctagaaatagcaagttaaaataaggctagtccgttatcaacttgaaaaagtggcaccgagtcggtgcttttttttacaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagctcagatcagcttgcatgcctgcagggg

SEQ ID NO: 354 - DNA, 7017 bp, Artificial Sequence
  PHV00011
cggatagatggcgtctagcatatcgataggacatgacaagtggtacgatccccgtcacatgtccatggaggcatctgatatggacacggcgtgtatctatcgcggctggaacagaaccagcgctcgcgcggcggtcggcgggagggacagaccttggctccgtgcgttcaggttgtgcttgtgccgcgcgccacgcacggtctccgccgcctgcagctgaaattttagatttacatcctatccctttattttttttatttgtcacaattcagttcaaaaatgaagaacggaggtagtgcatcctttgtgagactaatgaaaatcacatctggatcctgaaatcggcgtcgtaacctacaaggccacggactggattagatagtggtccatggtgcataatgaggatcgagggataacttcgtatagcatacattatacgaagttatggcgccgctagcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagggaagttcctattccgaagttcctattctctagaaagtataggaacttcagatccaccgggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccctagcgtatacgaagttcctattccgaagttcctattcttcaaaaagtataggaacttcgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtaccgaggccggccccgcgggagctcggcgcgccatgaggagcaatcattgttcaagacatgatgcaaagctagaaaactttgattgtggccgtcctaattgtgaagtttaggccggggggaacttcatgaaccctatcgaagcttaattagttcttttttgttgttagccatgtttgtattgtagtttaggtgaacaacatgacgccgcacccgcgatctcagggctcgtccccacacaggagggcacgtcgtcgtcttcgccgccgagcatcagagattcagagcacgtacacgcacatctcaagcaaacggagtagtacgtcctactcctacgtacatacctagccgacgacctttatgtgcacaccaccactgctctgctgcccggcctctccgtcgtccgttcatcaccagctggtctggtccttcaatttccatgcgtcggtccgacaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagctcagatcagcttgcatgcctgcagg

That which is claimed:

1. A method of producing a transgenic plant comprising:
providing to a plurality of haploid embryos or haploid embryo-like structures a trait gene expression cassette and a morphogenic gene expression cassette, the plurality of haploid embryos or haploid embryo-like structures comprising one or more first haploid embryos or embryo-like structures and one or more second haploid embryos or embryo-like structures, wherein at least one first haploid embryo or embryo-like structure includes the morphogenic gene expression cassette and expresses a morphogenic polypeptide;
inducing somatic embryogenesis in the one or more second haploid embryos or embryo-like structures resulting in one or more somatic embryos, wherein somatic embryogenesis is induced by contacting the one or more second haploid embryos or embryo-like structures with the morphogenic polypeptide expressed by the at least one first haploid embryo or embryo-like structure and translocated to the one or more second haploid embryos or embryo-like structures, wherein the one or more second haploid embryos or embryo-like structures do not include the morphogenic gene expression cassette;
selecting a somatic embryo comprising the trait gene expression cassette and lacking the morphogenic gene expression cassette;
contacting the selected somatic embryo with a chromosome doubling agent for a period sufficient to generate a doubled haploid embryo; and
regenerating a transgenic plant from the selected doubled haploid embryo, the transgenic plant comprising the trait gene expression cassette and lacking the morphogenic gene expression cassette.

2. The method of claim 1, wherein the trait gene expression cassette and the morphogenic gene expression cassette are provided via particle gun delivery.

3. The method of claim 2, wherein the trait gene expression cassette and the morphogenic gene expression cassette are delivered to the plurality of haploid embryos or haploid embryo-like structures simultaneously.

4. The method of claim 2, wherein the trait gene expression cassette and the morphogenic gene expression cassette are delivered to the plurality of haploid embryos or haploid embryo-like structures sequentially.

5. The method of claim 1, wherein the trait gene expression cassette and the morphogenic gene expression cassette are provided via bacterial-mediated delivery.

6. The method of claim 5, wherein the bacterial-mediated delivery comprises simultaneously contacting the plurality of haploid embryos or the haploid embryo-like structures with a T-DNA containing the trait gene expression cassette in a first bacterial strain and a T-DNA containing the morphogenic gene expression cassette in a second bacterial strain.

7. The method of claim 5, wherein the bacterial-mediated delivery comprises contacting the plurality of haploid embryos or the haploid embryo-like structures with a T-DNA containing the trait gene expression cassette and a T-DNA containing the morphogenic gene expression cassette in one bacterial strain.

8. The method of claim 1, wherein the morphogenic gene expression cassette comprises:

(i) a nucleotide sequence encoding a WUS/WOX polypeptide; or
(ii) a nucleotide sequence encoding a Babyboom (BBM) polypeptide or an Ovule Development Protein 2 (ODP2) polypeptide; or
(iii) a combination of (i) and (ii).

9. The method of claim 8, wherein the nucleotide sequence encoding the WUS/WOX polypeptide is selected from the group consisting of WUS1, WUS2, WUS3, WOX2A, WOX4, WOX5, and WOX9.

10. The method of claim 8, wherein the nucleotide sequence encoding the Babyboom (BBM) polypeptide is selected from the group consisting of BBM2, BMN2, and BMN3 or the Ovule Development Protein 2 (ODP2) polypeptide is ODP2.

11. The method of claim 1, wherein the trait gene expression cassette comprises:
a trait gene selected from the group consisting of a gene conferring pest resistance, a gene conferring herbicide resistance, a gene conferring stress tolerance, a gene conferring drought resistance, a gene conferring nitrogen use efficiency, a gene conferring disease resistance, and a gene conferring an ability to alter a metabolic pathway.

12. The method of claim 11, wherein the trait gene expression cassette further comprises a nucleotide sequence encoding a Babyboom (BBM) polypeptide or an Ovule Development Protein 2 (ODP2) polypeptide.

13. The method of claim 12, wherein the nucleotide sequence encoding the Babyboom (BBM) polypeptide is selected from the group consisting of BBM2, BMN2, and BMN3 or the Ovule Development Protein 2 (ODP2) polypeptide is ODP2.

14. The method of claim 1, wherein the trait gene expression cassette or the morphogenic gene expression cassette further comprises a polynucleotide encoding a site-specific nuclease.

15. The method of claim 14, wherein the site-specific nuclease is selected from the group consisting of a zinc finger nuclease, a meganuclease, TALEN, and a CRISPR-Cas nuclease.

16. The method of claim 15, wherein the CRISPR-Cas nuclease is a Cas9 or a Cpf1 nuclease.

17. The method of claim 14, wherein the site-specific nuclease effects an insertion, a deletion, or a substitution mutation.

18. The method of claim 15, further comprising providing a guide RNA expressed from the trait gene expression cassette or the morphogenic gene expression cassette.

19. The method of claim 18, wherein the guide RNA and CRISPR-Cas nuclease form a ribonucleoprotein complex.

20. The method of claim 6, wherein the first bacterial strain and the second bacterial strain are present in a 50:50 ratio, a 75:25 ratio, 90:10 ratio, a 95:5 ratio, or a 99:1 ratio.

21. The method of claim 8, wherein the morphogenic gene expression cassette further comprises a promoter selected from a group consisting of ZM-PLTP, SB-PLTP1, ZM-FBP1, ZM-RFP, ZM-APMP, ZM-RfeSP, ZM-CRR6, ZM-GLYK, ZM-CAB7, ZM-UBR, ZM-HBP, ZM-PSAN, ZM-SDR, AXIG1, DR5, ZM-PLTP1, ZM-PLTP2, SB-PLTP2, SB-PLTP3, SI-PLTP1, OS-PLTP1, OS-PLTP2, ZM-LGL PRO, ZM-LEA14 PRO, ZM-LEA34-D PRO, ZM-SDR PRO (long), OS-SDR PRO, SB-SDR PRO, and GM-EF1 A PRO or from a group consisting of SEQ ID NO: 35-105, and 106.

22. The method of claim 21, wherein the morphogenic gene expression cassette comprises a PLTP promoter operably linked to the nucleotide sequence encoding a functional WUS/WOX polypeptide.

23. The method of claim 8, wherein the morphogenic gene expression cassette further comprises an expression modulating element selected from the group consisting of SEQ ID NO: 107-173 and 174.

24. The method of claim 8, wherein the morphogenic gene expression cassette further comprises an enhancer selected from the group consisting of SEQ ID NO: 175-179 and 180.

25. The method of claim 8, wherein the morphogenic gene expression cassette further comprises an expression modulating element selected from the group consisting of SEQ ID NO: 107-173 and 174 and an enhancer selected from the group consisting of SEQ ID NO: 175-179 and 180.

26. The method of claim 8, wherein the morphogenic gene expression cassette further comprises three copies of an expression modulating element selected from the group consisting of SEQ ID NO: 107-173 and 174, wherein the three copies of the expression modulating element are the same or different expression modulating element.

27. The method of claim 8, wherein the morphogenic gene expression cassette further comprises three copies of an enhancer selected from the group consisting of SEQ ID NO: 175-179 and 180, wherein the three copies of the enhancer are the same or different enhancer.

28. The method of claim 8, wherein the morphogenic gene expression cassette further comprises three copies of an expression modulating element selected from the group consisting of SEQ ID NO: 107-173 and 174 and the enhancer comprises three copies of an enhancer selected from the group consisting of SEQ ID NO: 175-179 and 180, wherein the three copies of the expression modulating element are the same or different expression modulating element and/or the three copies of the enhancer are the same or different enhancer.

29. The method of claim 1, further comprising:
crossing the regenerated transgenic doubled haploid plant with a plant comprising a desired genotype/phenotype; and
growing offspring having the desired genotype/phenotype.

30. The method of claim 1, wherein the plurality of haploid embryos are maternal haploid embryos.

31. The method of claim 30, wherein the maternal haploid embryos are derived from pollination of a female parent plant with pollen from a haploid inducer male parent plant and the maternal haploid embryos result from paternal genome elimination.

32. The method of claim 31, wherein the female parent plant is a hybrid plant.

33. The method of claim 1, wherein the plurality of haploid embryos are microspore-derived haploid embryos.

34. The method of claim 1, wherein the plurality of haploid embryo-like structures are microspore-derived haploid embryo-like structures.

* * * * *